(12) United States Patent
Brown et al.

(10) Patent No.: US 11,155,622 B2
(45) Date of Patent: Oct. 26, 2021

(54) VIRUS ENCODING AN ANTI-TCR-COMPLEX ANTIBODY OR FRAGMENT

(71) Applicant: PSIOXUS THERAPEUTICS LIMITED, Abingdon (GB)

(72) Inventors: Alice Claire Noel Brown, Abingdon (GB); Brian Robert Champion, Abingdon (GB)

(73) Assignee: PSIOXUS THERAPEUTICS LIMITED, Abingdon (GB)

( * ) Notice: Subject to any disclaimer, the term of this patent is extended or adjusted under 35 U.S.C. 154(b) by 485 days.

(21) Appl. No.: 16/062,024

(22) PCT Filed: Dec. 19, 2016

(86) PCT No.: PCT/EP2016/081818
§ 371 (c)(1),
(2) Date: Jun. 13, 2018

(87) PCT Pub. No.: WO2017/103291
PCT Pub. Date: Jun. 22, 2017

(65) Prior Publication Data
US 2018/0369304 A1   Dec. 27, 2018

(30) Foreign Application Priority Data

| Dec. 17, 2015 | (GB) | 1522334 |
| Apr. 29, 2016 | (GB) | 1607463 |
| Oct. 10, 2016 | (GB) | 1617206 |
| Oct. 10, 2016 | (GB) | 1617207 |

(51) Int. Cl.
| C07K 16/28 | (2006.01) |
| A61K 35/761 | (2015.01) |
| A61K 38/17 | (2006.01) |
| C07K 14/00 | (2006.01) |
| A61K 35/768 | (2015.01) |
| A61P 35/00 | (2006.01) |
| C07K 14/005 | (2006.01) |
| C07K 14/725 | (2006.01) |
| C07K 16/30 | (2006.01) |
| C12N 7/00 | (2006.01) |
| C12N 15/86 | (2006.01) |
| A61K 39/00 | (2006.01) |

(52) U.S. Cl.
CPC ........ C07K 16/2809 (2013.01); A61K 35/761 (2013.01); A61K 35/768 (2013.01); A61K 38/1774 (2013.01); A61P 35/00 (2018.01); C07K 14/00 (2013.01); C07K 14/005 (2013.01); C07K 14/7051 (2013.01); C07K 16/2803 (2013.01); C07K 16/30 (2013.01); C12N 7/00 (2013.01); C12N 15/86 (2013.01); A61K 2039/505 (2013.01); C07K 2317/622 (2013.01); C07K 2317/73 (2013.01); C12N 2710/10032 (2013.01); C12N 2710/10041 (2013.01)

(58) Field of Classification Search
CPC ..................................................... C07K 16/28
See application file for complete search history.

(56) References Cited

U.S. PATENT DOCUMENTS

| 5,358,866 A | 10/1994 | Mullen et al. |
| 5,631,236 A | 5/1997 | Woo et al. |
| 5,648,478 A | 7/1997 | Henderson |
| 5,677,178 A | 10/1997 | McCormick |
| 5,843,772 A | 12/1998 | Devine et al. |
| 5,972,706 A | 10/1999 | McCormick |
| 6,291,214 B1 | 9/2001 | Richards et al. |
| 6,294,377 B1 | 9/2001 | Haddada et al. |
| 6,420,524 B1 | 7/2002 | Craig |
| 7,459,153 B2 | 12/2008 | Wadell et al. |
| 7,550,296 B2 | 6/2009 | Hermiston |
| 7,858,367 B2 | 12/2010 | Amalfitano et al. |
| 8,052,965 B2 | 8/2011 | Van Beusechem et al. |
| 8,216,819 B2 | 7/2012 | Hermiston |
| 2002/0019051 A1 | 2/2002 | Lusky |
| 2003/0017138 A1 | 1/2003 | Havenga et al. |
| 2003/0044384 A1 | 3/2003 | Roberts |
| 2003/0096787 A1 | 5/2003 | Perricaudet et al. |
| 2004/0151696 A1 | 8/2004 | Johnson et al. |
| 2004/0213764 A1 | 10/2004 | Wold et al. |

(Continued)

FOREIGN PATENT DOCUMENTS

| CN | 1241632 A | 1/2000 |
| CN | 1242051 A | 1/2000 |

(Continued)

OTHER PUBLICATIONS

Ferrantini et al. (2007, Biochimie, vol. 89, pp. 884-893). (Year: 2007).*

(Continued)

*Primary Examiner* — Thaian N. Ton
*Assistant Examiner* — David A Montanari
(74) *Attorney, Agent, or Firm* — Debora Plehn-Dujowich; Eckert Seamans Cherin & Mellott, LLC

(57) ABSTRACT

The present disclosure relates to a replication deficient oncolytic viral vector or replication capable oncolytic virus encoding an antibody or a binding fragment thereof to the antigen-specific T-cell receptor complex (TCR) for expression on the surface of a cancer cell, pharmaceutical compositions comprising the same, and use of any one of the same in treatment, particularly in the treatment of cancer.

20 Claims, 166 Drawing Sheets

Specification includes a Sequence Listing.

(56) References Cited

U.S. PATENT DOCUMENTS

| | | |
|---|---|---|
| 2005/0175589 A1 | 8/2005 | Iggo et al. |
| 2005/0186225 A1 | 8/2005 | Evans et al. |
| 2006/0140909 A1 | 6/2006 | Wickham et al. |
| 2006/0292682 A1 | 12/2006 | Hawkins et al. |
| 2008/0069836 A1 | 3/2008 | Nabel et al. |
| 2008/0292592 A1 | 11/2008 | Chuda et al. |
| 2009/0311219 A1 | 12/2009 | Bonastre et al. |
| 2012/0283318 A1 | 11/2012 | Mei et al. |
| 2013/0243731 A1 | 9/2013 | Dias et al. |
| 2017/0266243 A1 | 9/2017 | Champion et al. |

FOREIGN PATENT DOCUMENTS

| | | | |
|---|---|---|---|
| CN | 101381742 A | 3/2009 | |
| CN | 102586327 A | 7/2012 | |
| DE | 102005055128 A1 | 5/2007 | |
| EP | 1054064 A1 | 11/2000 | |
| JP | 2002531133 | 9/2002 | |
| JP | 200850051 A | 1/2008 | |
| JP | 2009505680 A | 2/2009 | |
| JP | 2010514418 A | 5/2010 | |
| SE | 0100035-5 | 1/2001 | |
| WO | 1998/022609 A1 | 5/1998 | |
| WO | 2000/15823 A1 | 3/2000 | |
| WO | 00/34494 | 6/2000 | |
| WO | 00/73478 A3 | 12/2000 | |
| WO | 01/53506 A2 | 7/2001 | |
| WO | 2001/092549 A2 | 12/2001 | |
| WO | 2002/053759 A1 | 7/2002 | |
| WO | 2003/040170 A2 | 5/2003 | |
| WO | 2003/064666 A1 | 8/2003 | |
| WO | 2005/010149 A1 | 6/2004 | |
| WO | 2004/108893 A2 | 12/2004 | |
| WO | 2005/040220 A1 | 5/2005 | |
| WO | 2005/086922 A2 | 9/2005 | |
| WO | 2005/107474 A2 | 11/2005 | |
| WO | 2005/118825 A2 | 12/2005 | |
| WO | 2006060314 A2 | 6/2006 | |
| WO | 2008/080003 | 7/2008 | |
| WO | 2009/143610 A1 | 12/2009 | |
| WO | 2012/024351 A1 | 2/2012 | |
| WO | 2013/074507 A1 | 5/2013 | |
| WO | 2014/138314 A1 | 9/2014 | |
| WO | 2015059303 A1 | 4/2015 | |
| WO | WO-2015059303 A1 * | 4/2015 | ........... A61K 35/761 |
| WO | WO-2015059465 A1 * | 4/2015 | ......... G01N 33/6893 |
| WO | 2015/077624 A1 | 5/2015 | |
| WO | 2015097220 A1 | 7/2015 | |
| WO | 2015155370 A1 | 10/2015 | |
| WO | 2016/030489 A1 | 3/2016 | |
| WO | 2016/139463 A1 | 9/2016 | |
| WO | 2016/146894 A1 | 9/2016 | |
| WO | 2016174200 A1 | 11/2016 | |
| WO | 2017/103290 A1 | 6/2017 | |
| WO | 2017/103291 A1 | 6/2017 | |
| WO | 2017/161360 A2 | 9/2017 | |
| WO | 2018/041827 A1 | 3/2018 | |
| WO | 2018/041838 | 3/2018 | |
| WO | 2018/075978 A1 | 4/2018 | |
| WO | 2018/083257 A1 | 5/2018 | |
| WO | 2018/083258 A1 | 5/2018 | |
| WO | 2018/083259 A1 | 5/2018 | |
| WO | 2019/043020 A1 | 3/2019 | |
| WO | 2019/149829 A1 | 8/2019 | |

OTHER PUBLICATIONS

Nakashima et al. (1996, Pharmaceutical Res., vol. 13(12), pp. 1896-1901) (Year: 1996).*
Kaufman et al. (2015, Nature Reviews, vol. 14, pp. 642-662) (Year: 2015).*
Ahmed et al, Intratumoral expression of a fusogenic membrane glycoprotein enhances the efficacy of replicating adenovirus therapy, Gene Therapy (2003) vol. 10, pp. 1663-1671.
Champion, AACR 106th Annual Meeting, Abstract 295: Delivery of checkpoint inhibitor antibodies and other therapeutics directly to tumors by encoding them within the oncolytic adenovirus enadenotucirev, 2015, vol. 75 (15: supple), Apr. 18. 2015, A295.
Alisky et al, Gene transfer to brain and spinal cord using recombinant adenoviral vectors, Methods in Mol Biol, vol. 246, 91-120, 2004.
Arafat et al, Effective single chain antibody (scFv) concentrations in vivo via adenoviral vector mediated expression of secretory scFv, Gene therapy, vol. 9, 256-262 (2002).
Biery et al, A simple in vitro Tn7-based transposition system with low target site selectivity for genome and gene analysis, Nucleic acids res, 28: 1067-1077 (2000).
Cascone et al, Upregulated stromal EGFR and vascular remodelling in mouse xenograft models of angiogenesis inhibitor-resistant human lung adenocarcinoma, J. clinical invest, vol. 121, No. 4, Apr. 1. 2011, 131-1328.
Casimiro et al, Comparative immunogenicity in rhesus monkeys of DNA plasmid, recombinant vaccinia virus and replication-defective adenovirus vectors, J. Virol 77, 6305-13 (2003).
Carlos et al, Bi-specific T-cell engager-armed oncolytic adenoviruses as a strategy to improve antitumor efficacy, Human gene, vol. 26, No. 9, Sep. 1, 2015, A13-14.
Mizuguchi et al, Approaches for generating recombinant adenovirus vectors, Advanced Drug Delivery Reviews, 2001, vol. 52, pp. 165-176.
Champion et al, Jul. 2016, Developing tumor-localized, combination immunotherapies, http://psioxus.com/wp-content/uploads/2016/12/AACR-Poster-Apr-2016.pdf.
Dias et al, Targeted cancer immunotherapy with oncolytic adenovirus coding for a fully human monoclonal antibody specific for CTLA-4, Gene therapy (2012), vol. 19, 988-998.
Dyer et al, Oncolytic Group B adenovirus Enadenotucirev mediates non-apoptotic cell death with membrane disruption and release of inflammatory mediators, Molecular therapy Oncolytics, vol. 4, Mar. 2017, 18-30.
Dyer A. et al, Antagonism of Glycolysis and Reductive Carboxylation of Glutamine Potentiates Activity of Oncolytic Adenoviruses in Cancer Cells, Cancer Res. 79:331 , 2019.
Fajardo et al, Bi-specific T-Cell Engager-Armed oncolytic adenoviruses as a strategy to improve antitumor efficacy, Human Gene Therapy, vol. 26, No. 9, A13-A14, Sep. 2015.
Fajardo et al, Oncolytic adenoviral delivery of an EGFR-targeting T-cell engager improves antitumor efficacy, Cancer Res, vol. 77, No. 8, Apr. 15, 2017, 2052-2063.
Feng et al, Cancer associated fibroblasts-targeted oncolytic virus results in enhanced antitumor activity in mouse model, Molecular therapy, vol. 23, no. supple 1, May 2015, S246.
Mei et al, Comparative analysis of the genome organization of human adenovirus 11, a member of the human adenovirus species B, and the commonly used human adenovirus 5 vector, a member of species C, J Gen Virol. vol. 84, no. part 8, Aug. 2003, 2061-2071.
Freedman et al, Oncolytic adenovirus expressing bispecific antibody targets T-cell cytotoxicity in cancer biopsies, EMBO molecular med, vol. 9, No. 8, Jun. 20, 2017, 1067-1087.
Freedman J.D. et al, An Oncolytic Virus Expressing a T-cell Engager Simultaneously Targets Cancer and Immunosuppressive Stromal Cells, Cancer Res Nov. 18: 1-14, 2018.
Frentzen et al, Anti-VEGF single=chain antibody GLAF-1 encoded by oncolytic vaccinia virus significantly enhances anti-tumor therapy, Proceedings Nat Aca Sci, vol. 106, No. 31, (Aug. 4, 2009), 12915-12920.
Forrester et al, Serotype-specific inactivation of the cellular DNA damage response during adenovirus infection, J. Vir 85(5), 2011, 2201-2211.
Fountzilas et al, Review: Oncolytic virotherapy, updates and future directions, Oncotarget, vol. 8, No. 60, May 31, 2017.
Fu et al, Expression of a Fusogenic Membrane Glycoprotein by an Oncolytic Herpes Simplex Virus Potentiates the Viral Antitumor Effect, Molecular Therapy, Jun. 2003, vol. 7, No. 6, pp. 748-754.
Galanis et al, Use of Viral Fusogenic Membrane Glycoproteins as Novel Therapeutic Transgenes in Gliomas, Human Gene Therapy, 2001, vol. 12, No. 7, pp. 811-821, Abstract.

(56) References Cited

OTHER PUBLICATIONS

Garcia-carbonero et al, Phase I study of intravenous administration of the chimeric adenovirus enadenotucirev in patients undergoing primary tumor resection, J immunotherapy of cancer, Biomed central ltd, vol. 5, No. 19 Sep. 2017, 1-13.

Grill et al, Mol. The organotypic multicellular spheroid is a relevant three-dimensional model to study adenovirus replication and penetration in human tumors in vitro, Therapy, vol. 6, No. 5, 609-614 (2002).

Heise et al, Onyx-015, an E1B gene-attenuated adenovirus, causes tumor-specific cytolysis and antitumoral efficacy that can be augmented by standard chemotherapeutic agents, Nat Met, vol. 3, No. 6, 639-645, 1997.

Champion et al, NG-348: a novel oncolytic virus designed to mediate anti-tumour activity via the potent and selective polyclonal activation of tumor-infiltrating T-cells, Cancer research, vol. 77, No. 13, Jul. 2017.

Hermiston, A demand for next-generation oncolytic adenoviruses, Curr. Op. Mol. Therapeutics 8, 322-30, Aug. 2006.

Machiels J-P. et al, A Phase 1 Dose Escalation Study of the Oncolytic Adenovirus Enadenotucirev, Administered Intravenously to Patients with Epithelial Solid Tumors, (EVOLVE) Journal for ImmunoTherapy of Cancer 7:20, 2019.

Hermiston T., Gene delivery from replication-selective viruses: arming guided missiles in the war against cancer, J Clinical invest, vol. 105, No. 9, (May 1, 2000), 1169-1172.

Ibrahimi et al, Highly efficient multicistronic lentiviral vectors with peptide 2A sequences, Human gene therapy 20: 845-860.

Illingworth et al, Preclinical Safety Studies of Enadenotucirev, a Chimeric Group B Human-Specific Oncolytic Adenovirus, Mol Ther Oncolytics. 5:62, 2017.

Hermiston T. et al, The Discovery and Development of Selectively Replicating Adenoviruses-Anticancer Agents, J Tumor targeting 2000, vol. 4 No. 4, 218-224.

Jolly D et al, Viral vector systems for gene therapy, Cancer gene therapy, vol. 1, No. 1, (1994) 51-64.

Kanerva et al, Gene transfer to ovarian cancer vs normal tisuses with fiber-modified adenoviruses, Molecular Therapy, vol. 5 (6), 2002, 695-704.

Kleinman & Martin, Matrigel: Basement membrane matrix with biological activity, Seminars in cancer biology 15, 378-86, Oct. 1, 2005.

Lai et al, Adenovirus and adeno-associated virus vectors, DNA Cell Bio, vol. 21, No. 12, 895-913 (2002).

Kuhn et al, 319. ColoAd1, a chimeric Ad11p/Ad3 Oncolytic virus for the treatment of colon cancer, Molecular Therapy, vol. 11, Aug. 15, 2005, p. 124.

Lee et al, Replicating adenoviral vector-mediated transfer of a heat-inducible double suicide gene for gene therapy, Cancer gene therapy, vol. 8, No. 6, 397-404 (2001).

Liao et al, Stable expression of chimeric anti-CD3 receptors on mammalian cells for stimulation of anti-tumor immunity, Cancer gene therapy 10, 2003, 779-790.

Kangasniemi, Improving oncolytic adenoviral therapies for gastrointestinal cancers and tumor initiating cells, Cancer Gene Therapy Group, Jan. 1, 2010, 1-70.

Luckow et al, Efficient generation of infectious recombinant baculoviruses by site-specific transposon-mediated insertion of foreign genes into a baculovirus genome propagated in *Esherichia coli*, Vorl. 67:4566-4579 (1993).

Marino et al, Development of a versatile oncolytic virus platform for local intra-tumoral expression of therapeutic transgenes, pLOS One, May 18, 2017, 1-23.

McConnell & Imperiale, Biology of adenovirus and its use as a vector for gene therapy, Human Gene therapy 1022-1033, Nov. 11, 2014.

McVey et al, Rapid construction of adenoviral vectors by lambda phage genetics, J. Virol, vol. 76, No. 8, 3670-3677 (Apr. 2002).

Meinschad & Winnacker, Recombination in adenovirus. I. Analysis of recombinant viruses under non-selective conditions, J of Gen. Virol. 1980, vol. 48, 219-224.

Francini, N. et al, Polyvalent Diazonium Polymers Provide Efficient Protection of Oncolytic Adenovirus Enadenotucirev from Neutralizing Antibodies while Maintaining Biological Activity In Vitro and In Vivo, Bioconjug Chem. 30:1244, 2019.

Champion, B. R., et al., Arming the chimeric oncolytic adenovirus enadenotucirev to deliver checkpoint inhibitors and other therapeutics directly to tumours, J Immunother Cancer. 2014; 2(Suppl 3): p. 46.

International Search Report and Written Opinion for PCT International Application No. PCT/EP2016/081818 dated May 11, 2017.

Paul, et al., The combination of a chemokine, cytokine and TCR-based T cell stimulus for effective gene therapy of cancer, Cancer Immunol Immunother. 51(11-12) ,2002 ,645-654.

Paul, et al., Tumor gene therapy by MVA-mediated expression of T-cell—stimulating antibodies, Cancer Gene Therapy 9 ,2002 ,470-477.

Hoffmann, et al., "Efficient generation of double heterologous promoter controlled oncolytic adenovirus vectors by a single homologous recombination step in *Escherichia coli*", BMC Biotechnol. Aug. 6, 2006, 36.

Janssen, et al., "Development of an AdEasy-based system to produce first—and second-generation adenoviral vectors with tropism for CAR—or CD46-positive cells", J Gene Med. 15(1), Jan. 1-11, 2013.

Li, et al., "A one-step ligation system for rapid generation of armed, conditionally-replicating adenoviruses", Biotechnol Lett. 35, Apr. 2013, 1215-1221.

English abstract for International Publication No. WO2008080003 (corresponding to Japanese Publication No. JP2010514418).

English abstract for Publication No. US2005265973 (corresponding to Japanese Publication No. JP2008500051).

English abstract for International Publication No. WO2007027860 (corresponding to Japanese Publication No. JP2009505680).

Mukherjee et al, Identification of EpCAM as a Molecular target of prostate cancer stroma, American J of pathology, vol. 175, No. 6, Dec. 1, 2009, 2277-2287.

Demers et al, Pharmacologic indicators of antitumor efficacy for oncolytic virotherapy, Cancer research, vol. 63, No. 14 (Jul. 15, 2003), 4003-4008.

Oorschot et al, Apoptin induces apoptosis in human transformed and malignant cells but not in normal cells, PNAS, May 1997, vol. 94, pp. 5843-5847.

Parks et al, Adenoviral vectors: prospects for gene delivery to the central nervous system, Gene Therapy, 1999, vol. 6, 1349-1350.

Kuhn, I., et al., Human adeno virus B strain ColoAd1,complete genome, 2006, Genbank accession No. EF011630.

Kuhn, I., et al., Directed Evolution Generatesa Novel Oncolytic Virus for the Treatment of Colon Cancer, PLos One, Jun. 2008I vol. 3 I Issue6 I e2409.

Di, Y., et al, Activity of a Group B Oncolytic Adenovirus (ColoAd1) in Whole Human Blood, Gene Ther. Apr. 2014;21(4):440-3.

Puthupparampil et al, Tumor growth inhibition from tumor targeted delivery of diphtheria toxin gene, Mol Therapy, 2005, vol. 11, supplement No. 1, A124.

Human Vaccines & Immunotherapeutics 8:11, 1550-1553; Nov. 2012, Unique anti-cancer agent ColoAd1 enters the clinic, www.landesbioscience.com.

Raum et al, Abstract 2434L Novel primate-crossreactive biTE antibodies that eliminate cancer cells expressing cMet, IGFR-1, FAP-alpha, PSCA, Endosialin, CAIX or Her2/neu, AACR 101st annual meeting 2010, Abstract.

Rancourt et al, Conditionally replicative adenoviruses for cancer therapy, 6th delivery review 27 (1997): 67-81.

Richards et al, The Amid system: Generation of recombinant adenoviruses by Tn7-mediated transposition in *E. coli*, Biotechniques vol. 29, No. 1, 146-154 (2000).

Roshon et al, Gene trap mutagenesis of hnRNP A2/B1: a cryptic 3' splice site in the neomycin resistance gene allows continued expression of the disrupted cellular gene, BMC Genomics, vol. 4, No. 2, 1-11 (2003).

(56) References Cited

OTHER PUBLICATIONS

Sirena et al, The nucleotide sequence and a first generation gene transfer vector of species B human adenovirus serotype 3, Virol. 343, 283-98 (2005).
Sood et al, Functional role of matrix metalloproteinases in ovarian tumor cell plasticity, Am. J. Obstetrics Gynecol. 196, 899-909 (2004).
Stellwagan et al, Gain of function mutations in TnsC, an ATP-dependent transposition protein that activates the bacterial transposon Tn7, Genetics 145: 573-585 (1997).
Stevenson et al, Selective targeting of human cells by a chimeric adenovirus vector containing a modified fiber protein, J virol. vol. 71, No. 6, 4782-4790, (1997).
Stone, D., et al, Development and Assessment of Human Adenovirus Type 11 as a Gene Transfer Vector, J Virol. Apr. 2005;79(8):5090-104.
Tedcastle A. et al, Actin-resistant DNAse I Expression From Oncolytic Adenovirus Enadenotucirev Enhances Its Intratumoral Spread and Reduces Tumor Growth, Mol Ther. 24:796, 2014.
Thorne et al, Oncolytic virotherapy: Approaches to tumor targeting and enhancing antitumor effects, Sem oncol. 32, 537-48, Dec. 1, 2005.
Tobias et al, Novel primate-crossreactive BiTE antibodies that eliminate cancer cells expressing cMEt, IGFR-1, FAP-alpha, PSCA, Endosialin, CAIX or Her2/neu, Proceedings of annual meeting of American association for cancer res, vol. 51, p. 590.
Tollefson et al, The Adenovirus Death Protein (E3-11.6K) is Required at Very Late Stages of Infection for Efficient Cell Lysis and Release of Adenovirus from Infected Cells, Journal of Virology, Apr. 1996, vol. 70, No. 4, pp. 2296-2306.
Wang et al, High levels of EGFR expression in tumor stroma are associated with aggressive clinical features in epithelial ovarian cancer, Oncotargets and therapy, vol. 9, Jan. 19, 2016, 377-386.
Yan et al, Developing Novel Oncolytic Adenoviruses through bioselection, J Virol. vol. 77, No. 4, Feb. 2003, 2640-2650.
Yang et al, Anti-CD3 scFV-B7.1 fusion protein expressed on the surface of HeLa cells provokes potent T-lymphocyte activation and cytotoxicity, Biochem cell Biol, 85(2), 2007, 196-202.
Illingworth, S., et al., Preclinical Safety Studies of Enadenotucirev, a Chimeric Group B Human-Specific Oncolytic Adenovirus, Mol Ther Oncolytics. Mar. 29, 2017;5:62-74.
Raki, M., et al, Oncolytic Adenovirus Ad5/3-delta24 and Chemotherapy for Treatment of Orthotopic Ovarian Cancer, Gynecol Oncol. Jan. 2008;108(1):166-72.
Russell, S. J., et al, Oncolytic Virotherapy, Nat Biotechnol. Jul. 10, 2012;30(7):658-70.
Vellinga, J., et al, The Adenovirus Capsid: Major Progress in Minor Proteins, J Gen Virol. Jun. 2005;86(Pt 6)1581-1588.
Jin, F., et al., Identification of Novel Insertion Sites in the Ad5 Genome That Utilize the Ad Splicing Machinery for Therapeutic Gene Expression, Moleculartherapy vol. 12, No. 6, Dec. 2005.
Hermiston, T.W., et al., ReviewArmed therapeutic viruses: Strategies and challengesto arming oncolytic viruses with therapeutic genes, Cancer Gene Therapy (2002) 9, 1022-1035.
Funston, G. M., et al., Expression of heterologous genes in oncolytic adenoviruses using picornaviral 2A sequences that trigger ribosome skipping, J Gen Virol . Feb. 2008;89(Pt 2):389-396.
Lee, C. H., et al., Tumor-localized ligation of CD3 and CD28 with systemic regulatory T-cell depletion induces potent innate and adaptive antitumor responses, Clin Cancer Res . Apr. 15, 2009;15(8):2756-66.
Liao, K.W., et al., Activation of lymphocytes by anti-CD3 single-chain antibody dimers expressed on the plasma membrane of tumor cells, Gene Ther. Feb. 2000;7(4):339-47.

Champion, B. R., et al., Abstract 4875: Developing tumor-localized, combination immunotherapies, Cacer Res. vol. 76, No. 14 suppl. Jul. 15, 2016.
Calvo et al, A First-in-class, a first-in-human phase I study of enadenotuciry an oncolytic Ad11/Ad3 chemeric group B adenovirus, administered intravenously in patients with metastatic epithelial tumors, Journal of Clinical Oncology vol. 32, No. 15 suppl (May 2014), abstract 3103.
Holterman, L., et al., Novel Replication-Incompetent Vector Derived from Adenovirus Type 11 (Ad11) for Vaccination and Gene Therapy: Low Seroprevalence and Non-Cross-Reactivity with Ad5, Journal of Virology, Dec. 2004, p. 13207-13215.
Nettelbeck et al, Cellular genetic tools to control oncolytic adenoviruses for virotherapy of cancer, J Mol Med (2008) 86:363-377.
Boni et al, A Phase 1 Mechanism of Action Study of Intra-Tumoural (IT) or Intravenous (IV) Administration of Enadenotucirev, An Oncolytic AD11/AD3 Chimeric Group B Adenovirus in Colon Cancer Patients Undergoing Resection of Primary Tumour, Annals of Oncology 25 (supplement 4): iv361-iv372, 2014.
Fuerer and Iggo, 5-Fluorocytosine increases the toxicity of Wnt-targeting replicating adenoviruses that express cytosine deaminase as a late gene, Gene Therapy (2004), 11, 142-151.
Chia S.L. et al, Group B adenovirus enadenotucirev infects polarised colorectal cancer cells efficiently from the basolateral surface expected to be encountered during intravenous delivery to treat disseminated cancer, Virology 505:162, 2017.
Choi, K-J, et al., Concurrent delivery of GM-CSF and B7-1 using an oncolytic adenovirus elicits potent antitumor effect, Gene Ther. Jul. 2006;13(13):1010-20.
Alemany, R., Oncolytic Adenoviruses in Cancer Treatment, Biomedicines 2014, 2, 36-49.
Nemunaitis, J., et al., Intravenous infusion of a replication-selective adenovirus (ONYX-015) in cancer patients: safety, feasibility and biological activity, Gene Therapy (2001) 8, 746-759.
Hemminki, A., Oncolytic Immunotherapy: Where Are We Clinically?, Scientitica, vol. 2014, Article ID 862925, 7 pages.
Hobbs, W. E., et al., Efficient Activation of Viral Genomes by Levels of Herpes Simplex Virus ICP0 Insufficient to Affect Cellular Gene Expression or Cell Survival, Journal of Virology, Apr. 2001, p. 3391-3403.
Hu, Z-B, et al., A simplified system for generating oncolytic adenovirus vector carrying one or two transgenes, Cancer Gene Therapy vol. 15, pp. 173-182(2008).
Illingworth et al, ColoAd1 a group B oncolytic adenovirus: preclinical assessment of potency, safety and selectivity, Human gene therapy, vol. 23, No. 10, Oct. 2012, p. A19.
Jiang et al, the controlled transgene expression in oncolytic adenoviral vectors with major late promoter for therapy of cancer, Mol. Therapy 13(Supp 1), 2006, S251.
Kwon, O-J, et al., Therapeutic targeting of chitosan-PEG-folate-complexed oncolytic adenovirus for active and systemic cancer gene therapy, J Control Release, Aug. 10, 2013;169(3):257-65.
Lee, Y-S, et al., Enhanced Antitumor Effect of Oncolytic Adenovirus Expressing Interleukin-12 and B7-1 in an Immunocompetent Murine Model, Clin Cancer Res 2006;5859 12(19) Oct. 1, 2006.
Pol, J., et al., Trial Watch Oncolytic viruses for cancer therapy, OncoImmunology 3, e28694; Apr. 2014.
Pützer, B. M., et al., Improved treatment of pancreatic cancer by IL-12 and B7.1 costimulation: antitumor efficacy and immunoregulation in a nonimmunogenic tumor model, Mol Ther. Apr. 2002;5(4):405-12.
Small, E. J., A Phase I Trial of Intravenous CG7870, a Replication-Selective, Prostate-Specific Antigen—Targeted Oncolytic Adenovirus, for the Treatment of Hormone-Refractory, Metastatic Prostate Cancer, Molecular Therapy vol. 14, No. 1, Jul. 2006.

\* cited by examiner

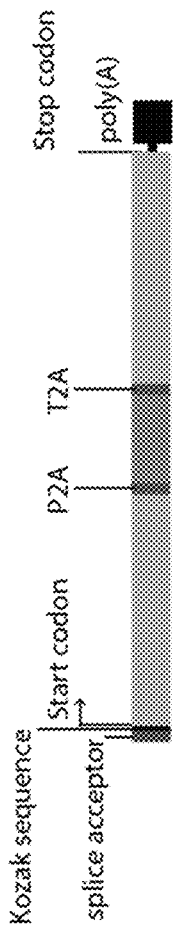
Figure 2D
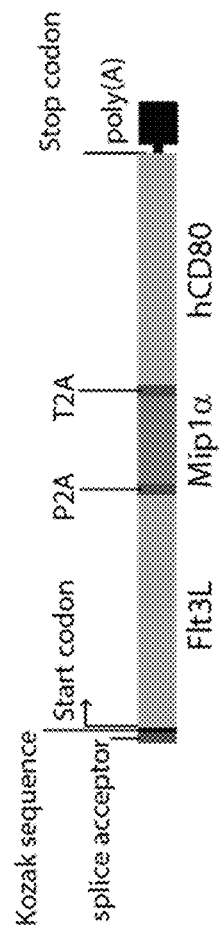
Figure 2E
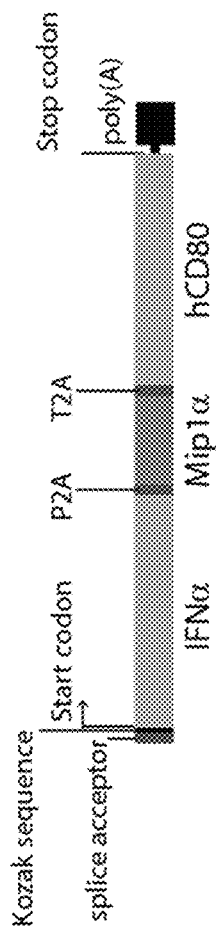
Figure 2F
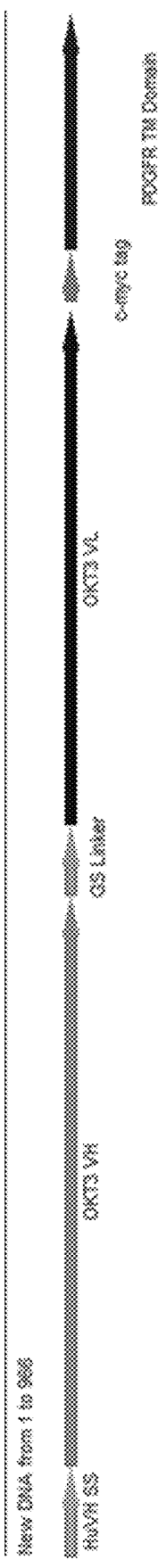
Figure 2G  ORF cassette for scFv antibody Figure 3
A
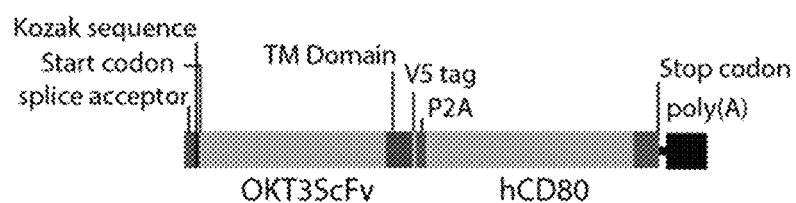
B
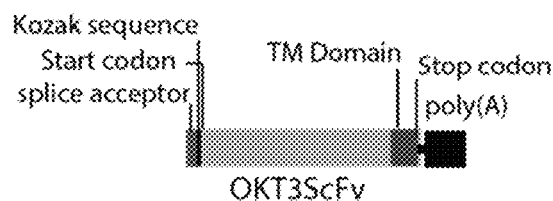
C
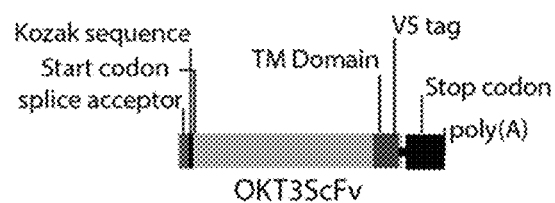

Figure 7A
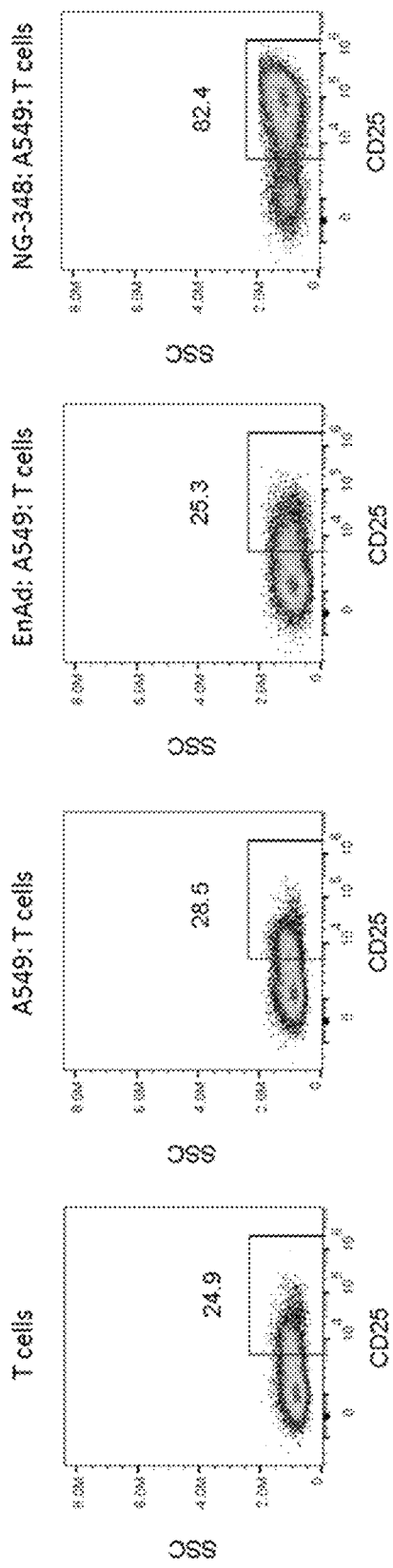
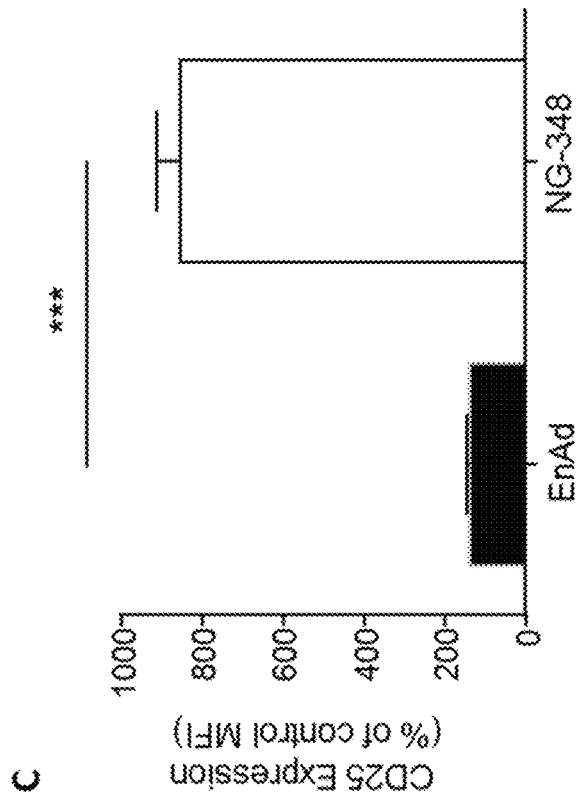
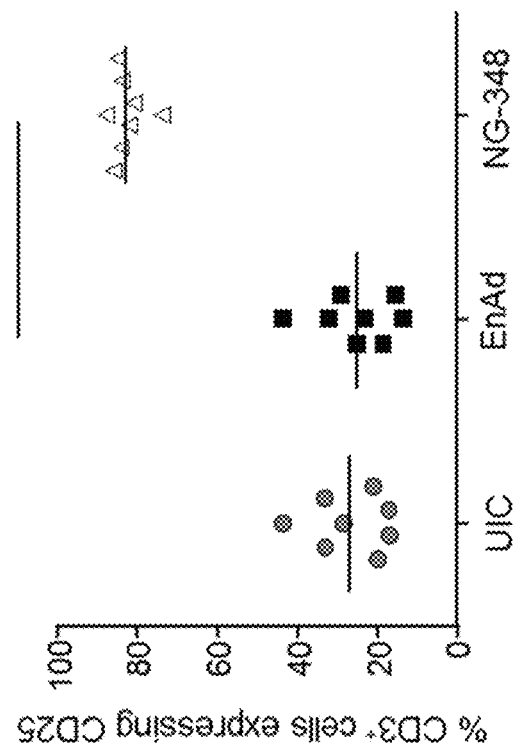

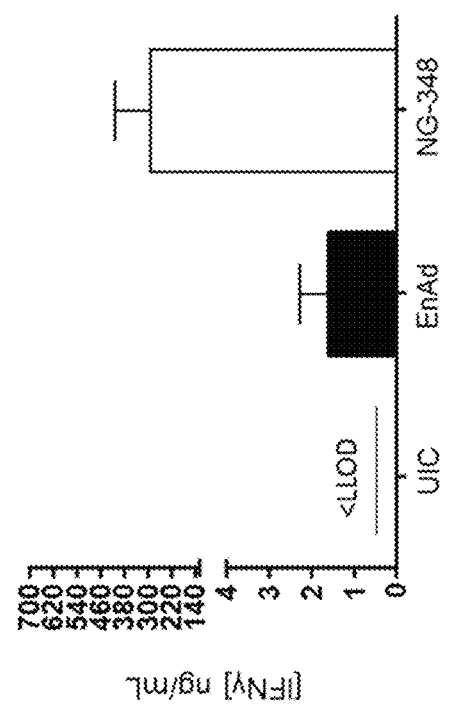
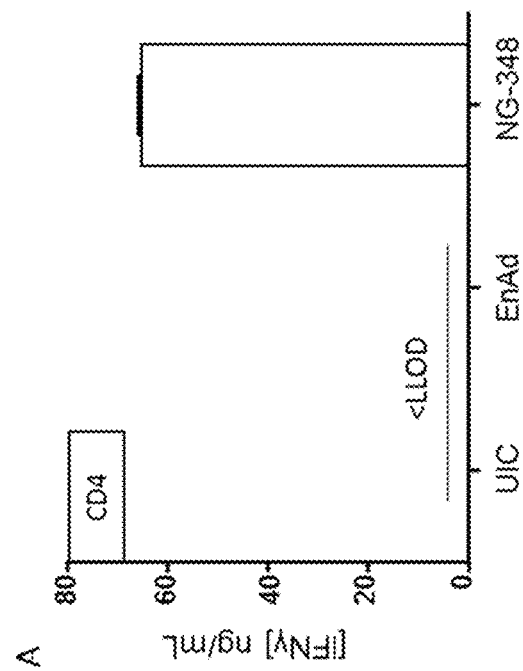
Figure 12
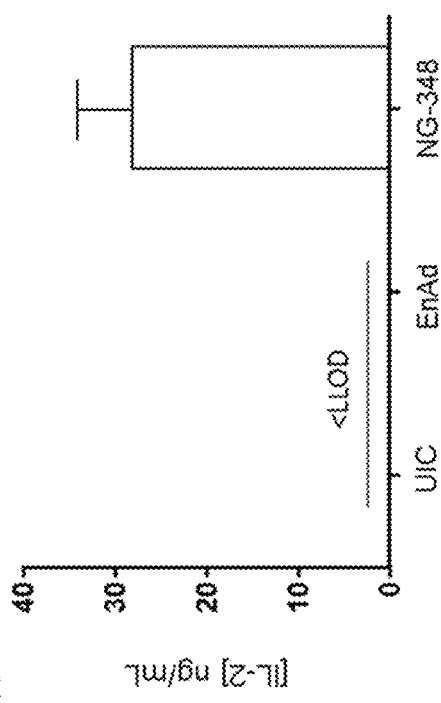
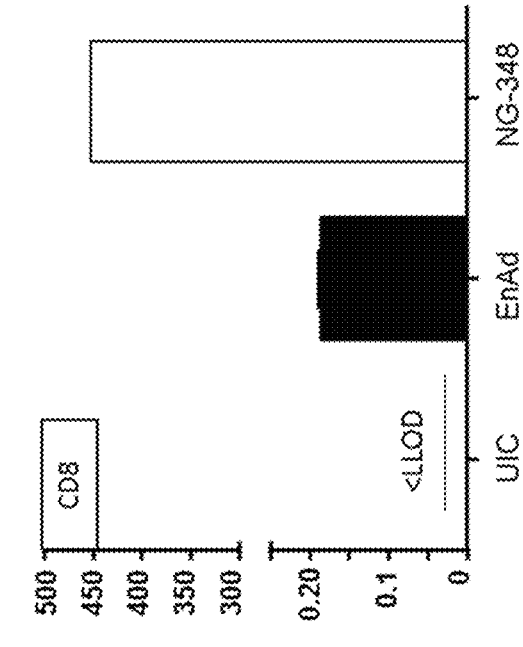
Figure 13

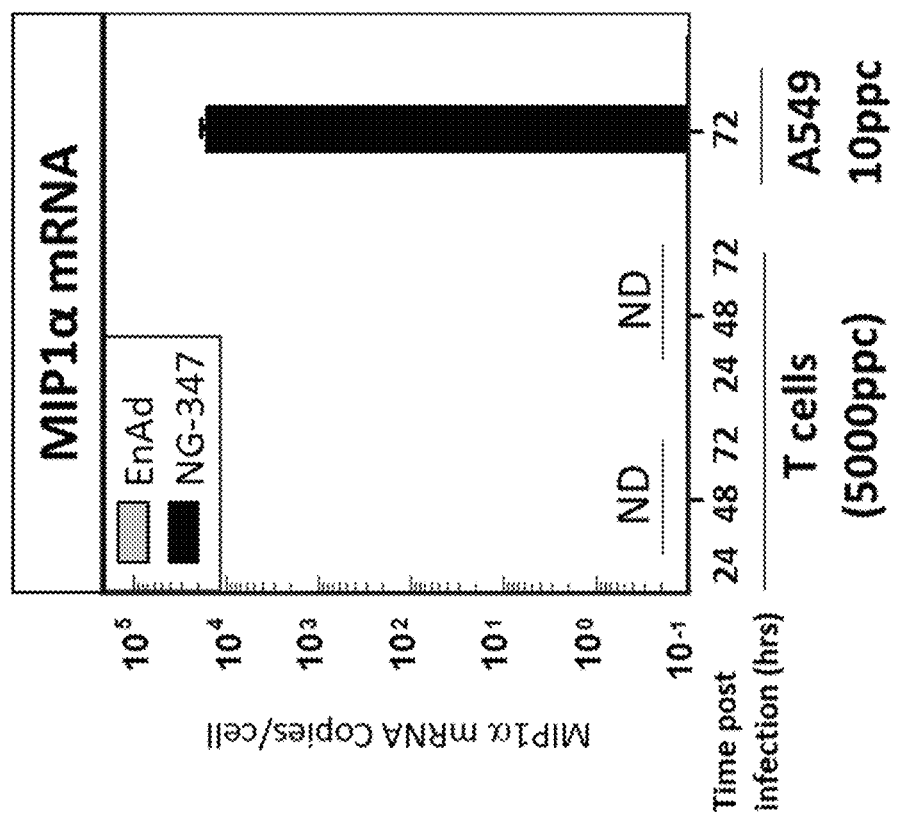
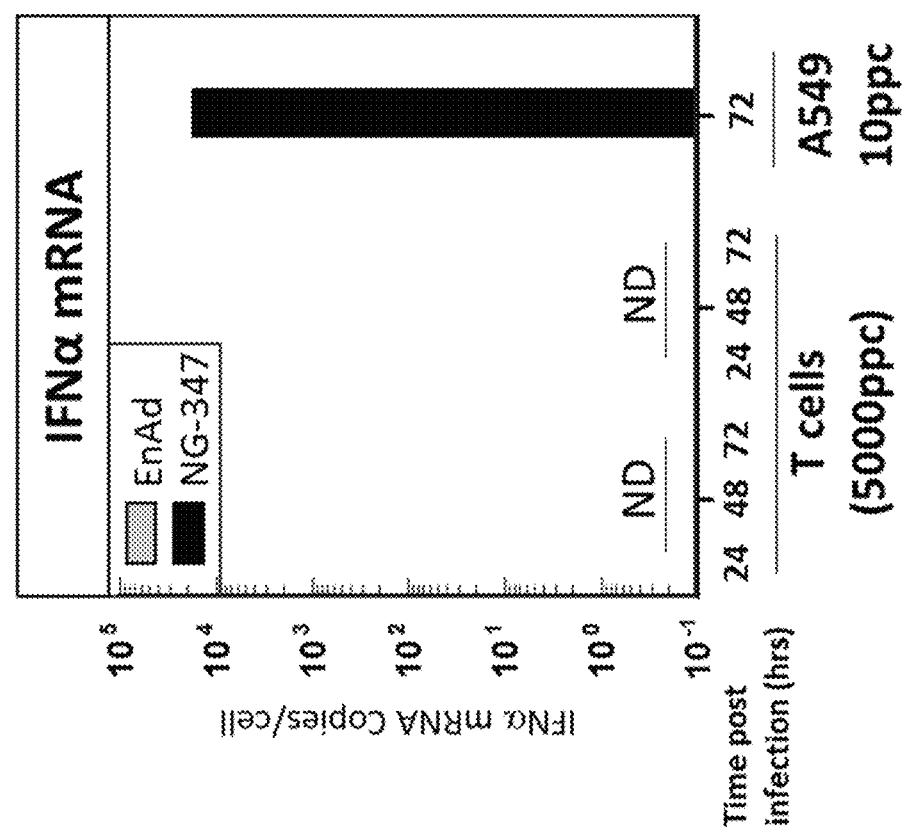
Figure 21

Figure 44
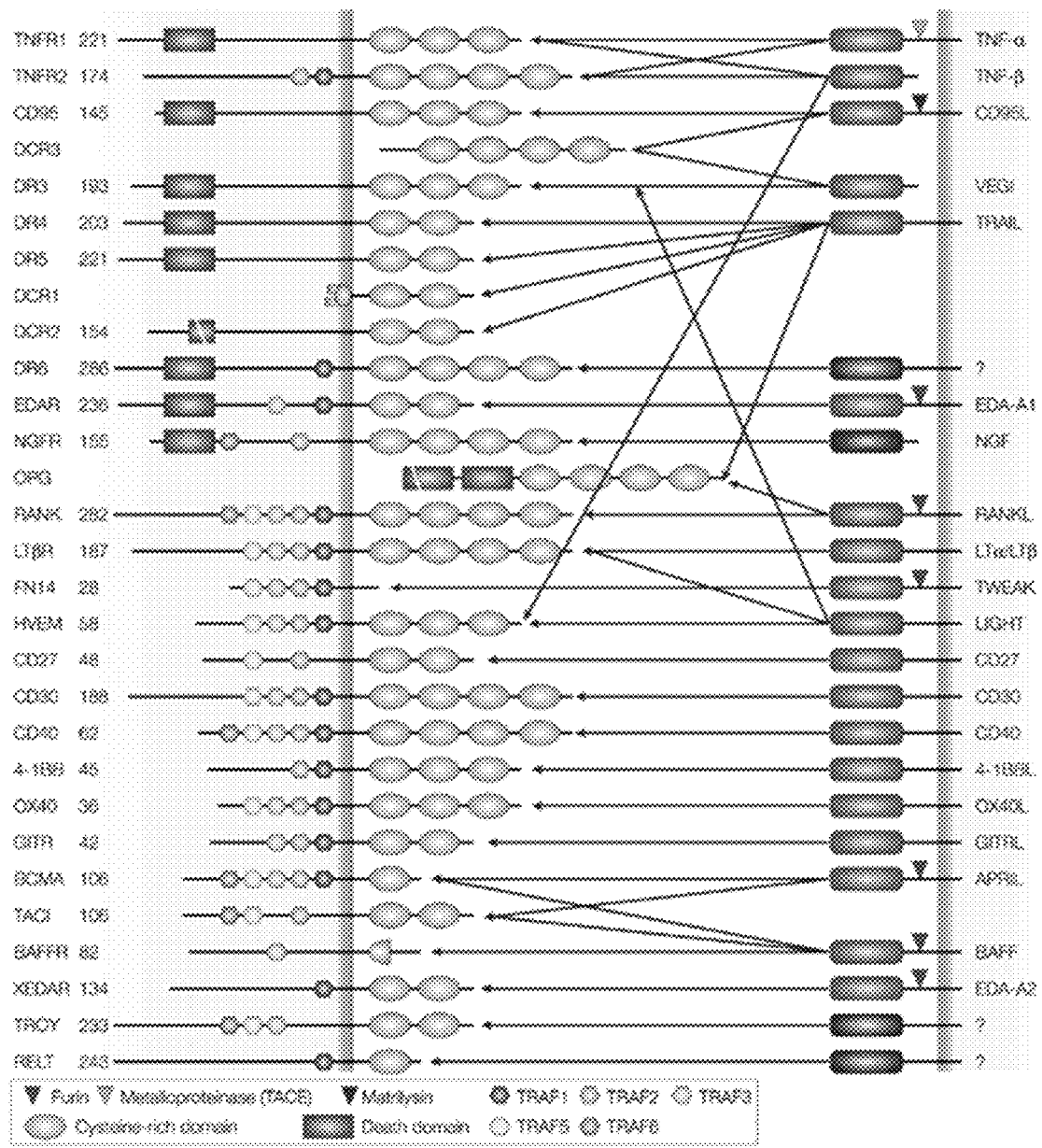
FIGURE 45    RECOMBINANT HSV-1 CONTAINING TRANSGENE X WITH BOTH COPIES OF ICP34.5 DELETED
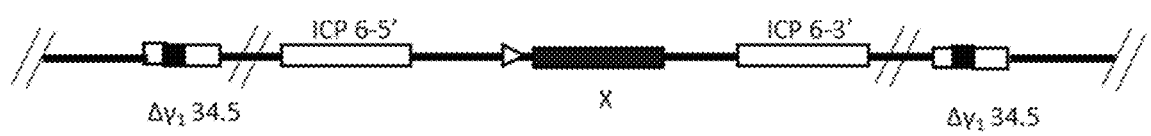

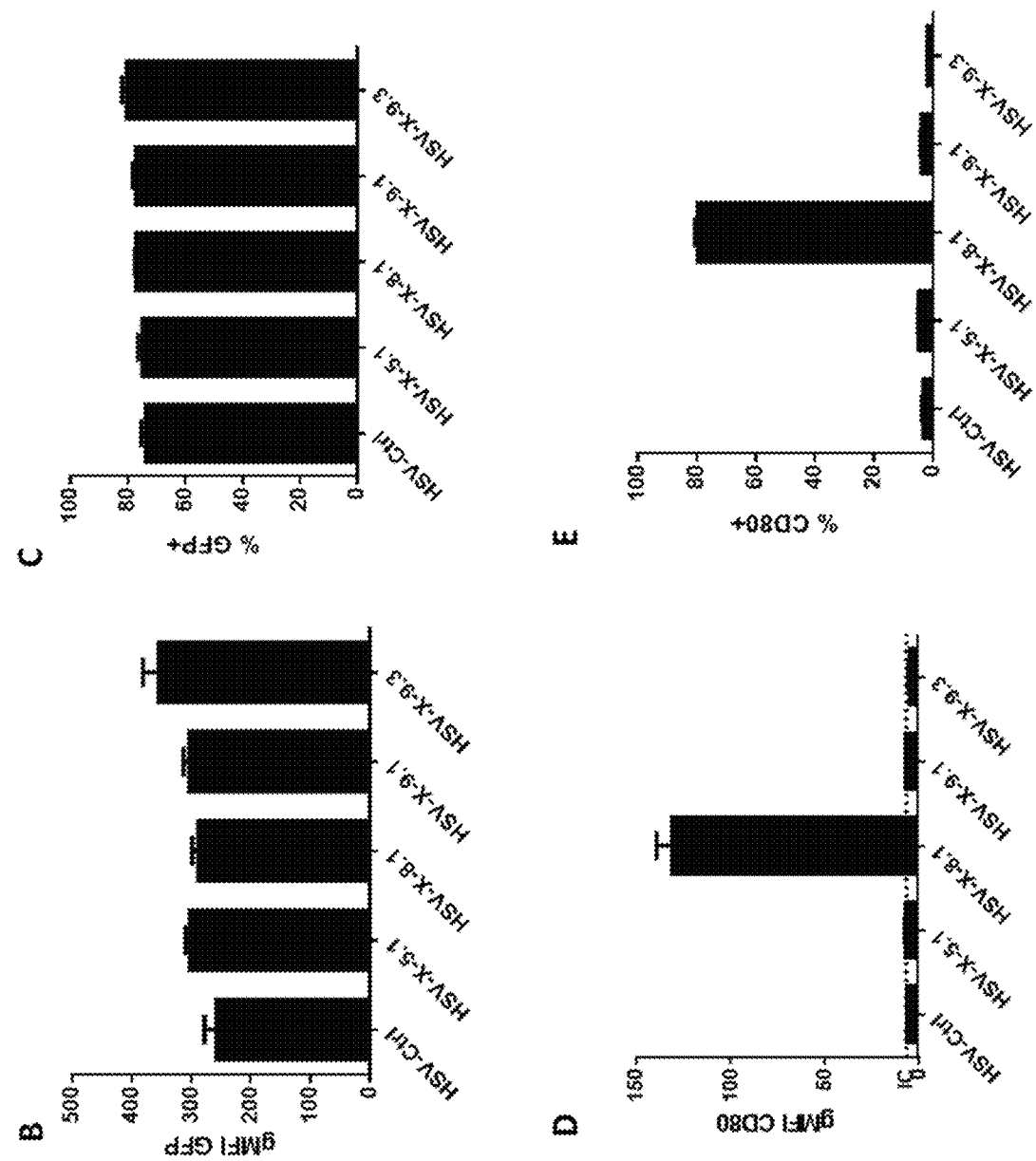
Figure 46B-E

Figure 46F continued
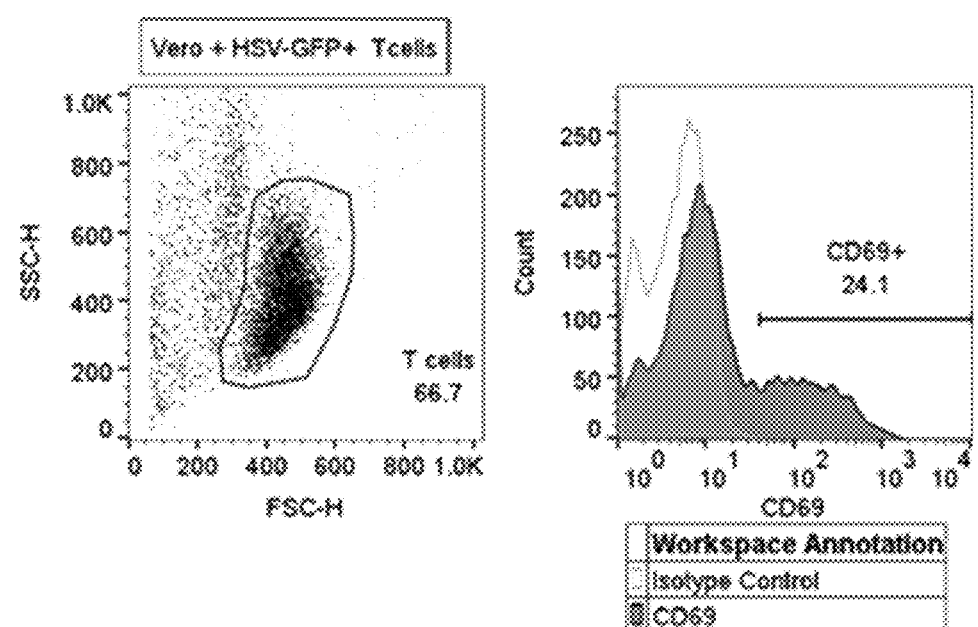
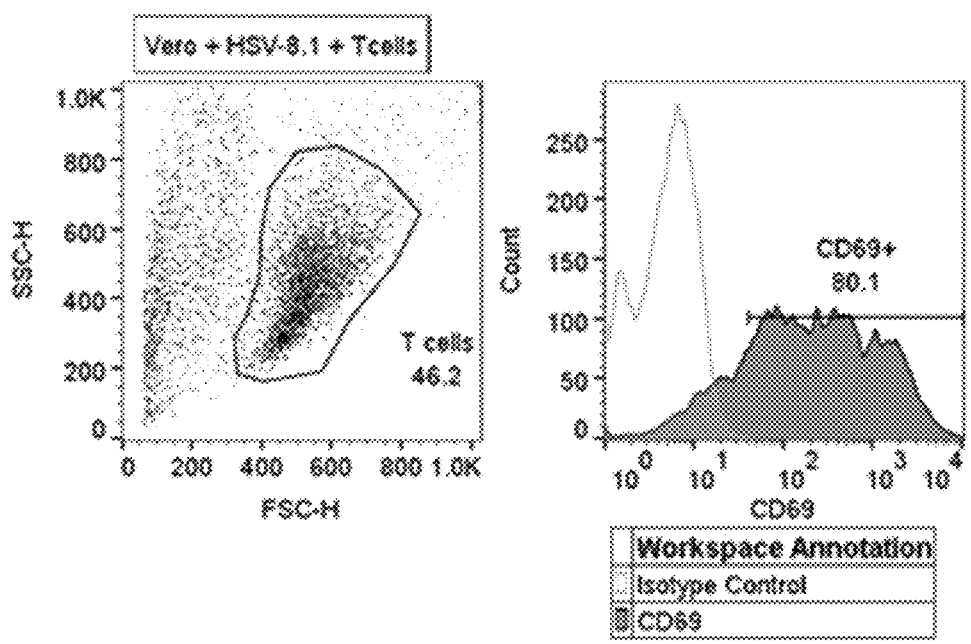

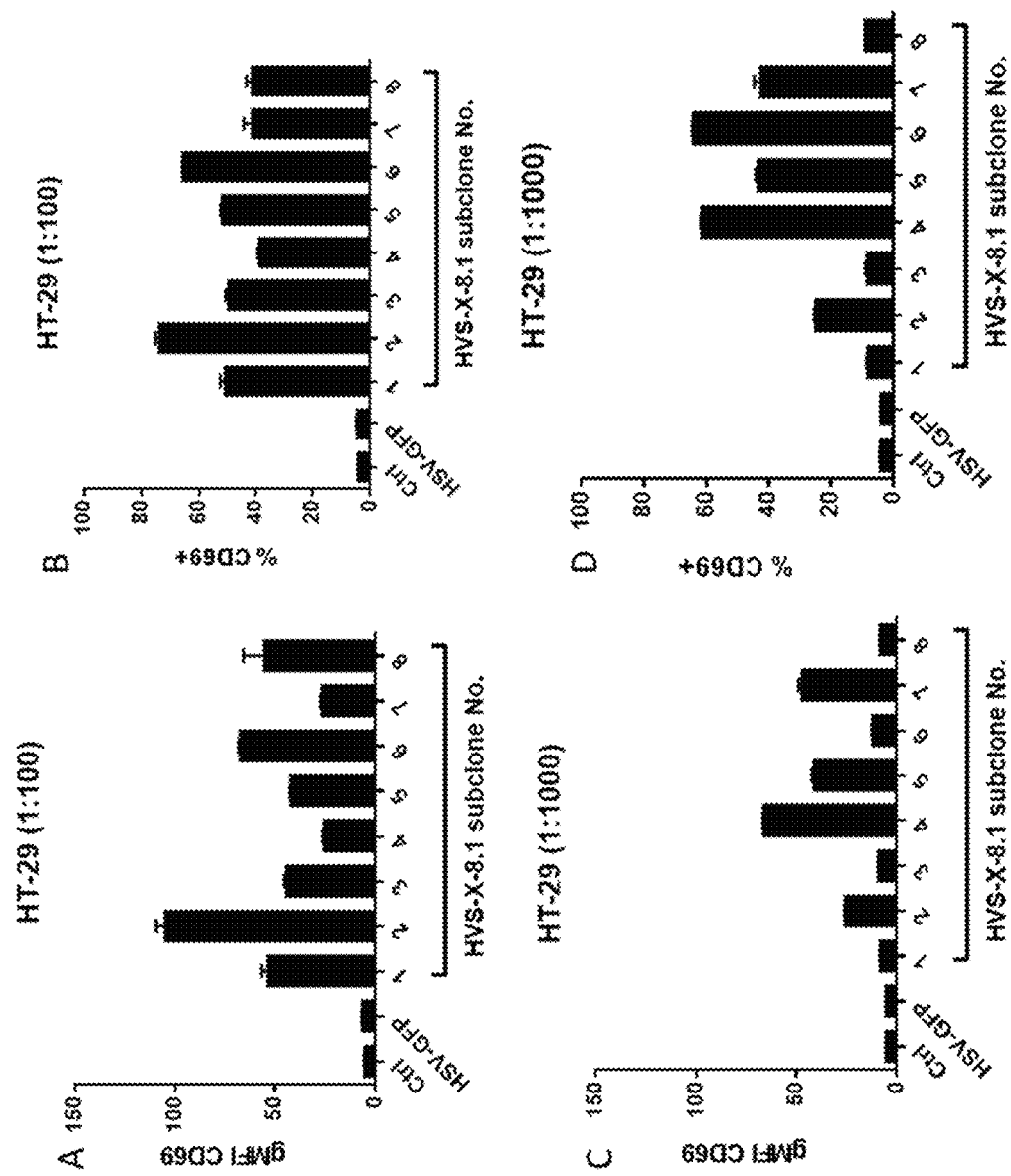
Figure 47A-D

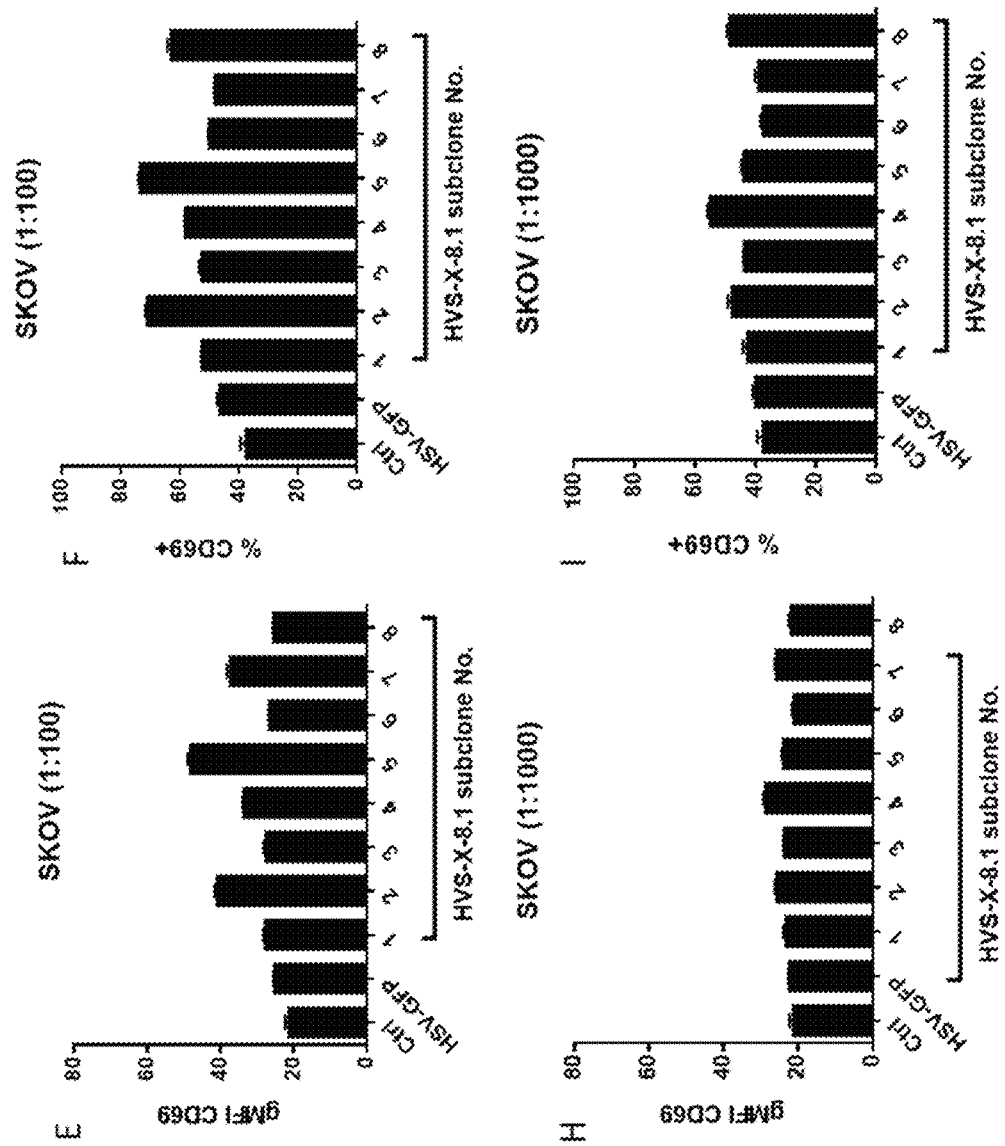
Figure 47E-I

Figure 52C-F
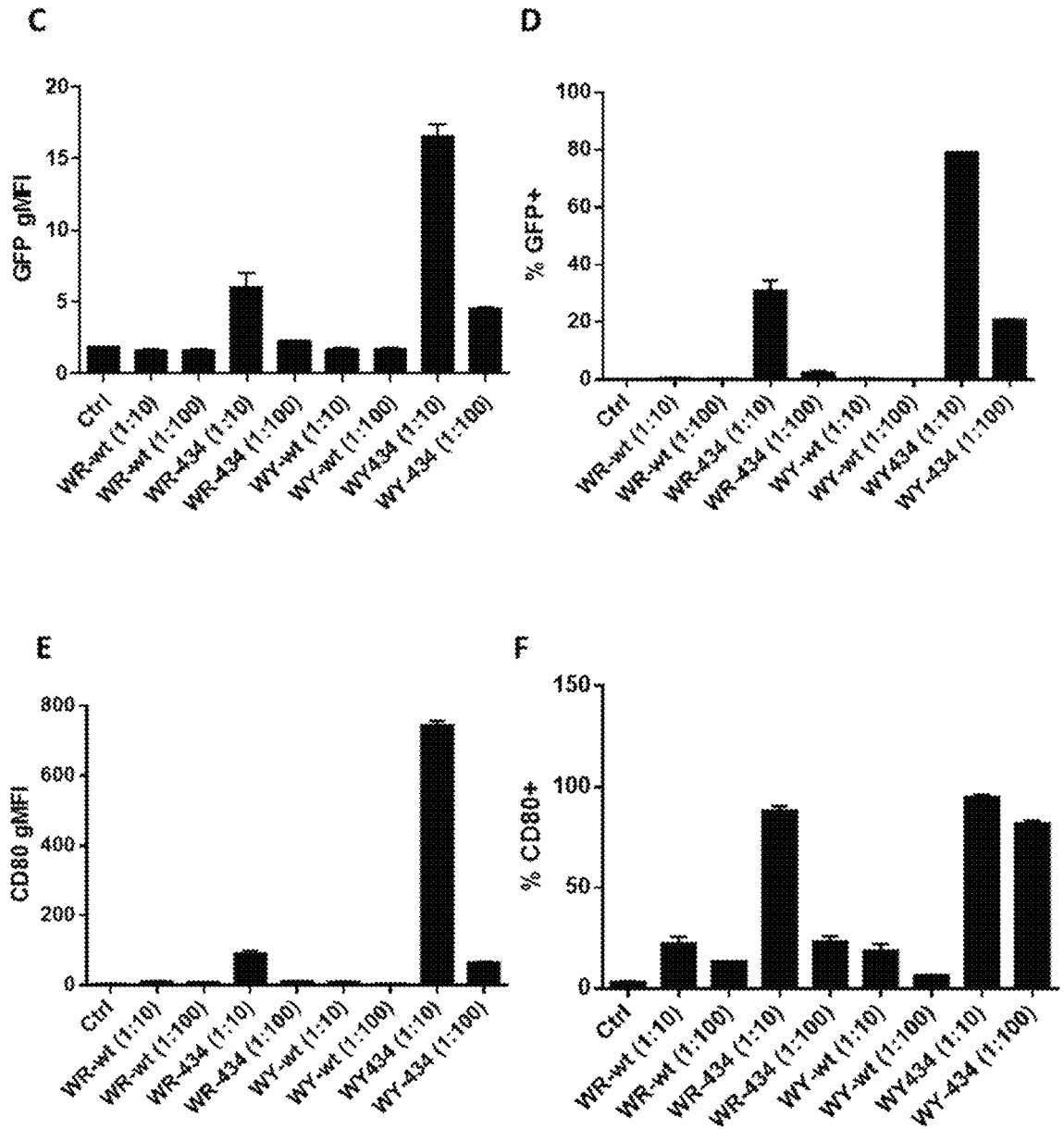

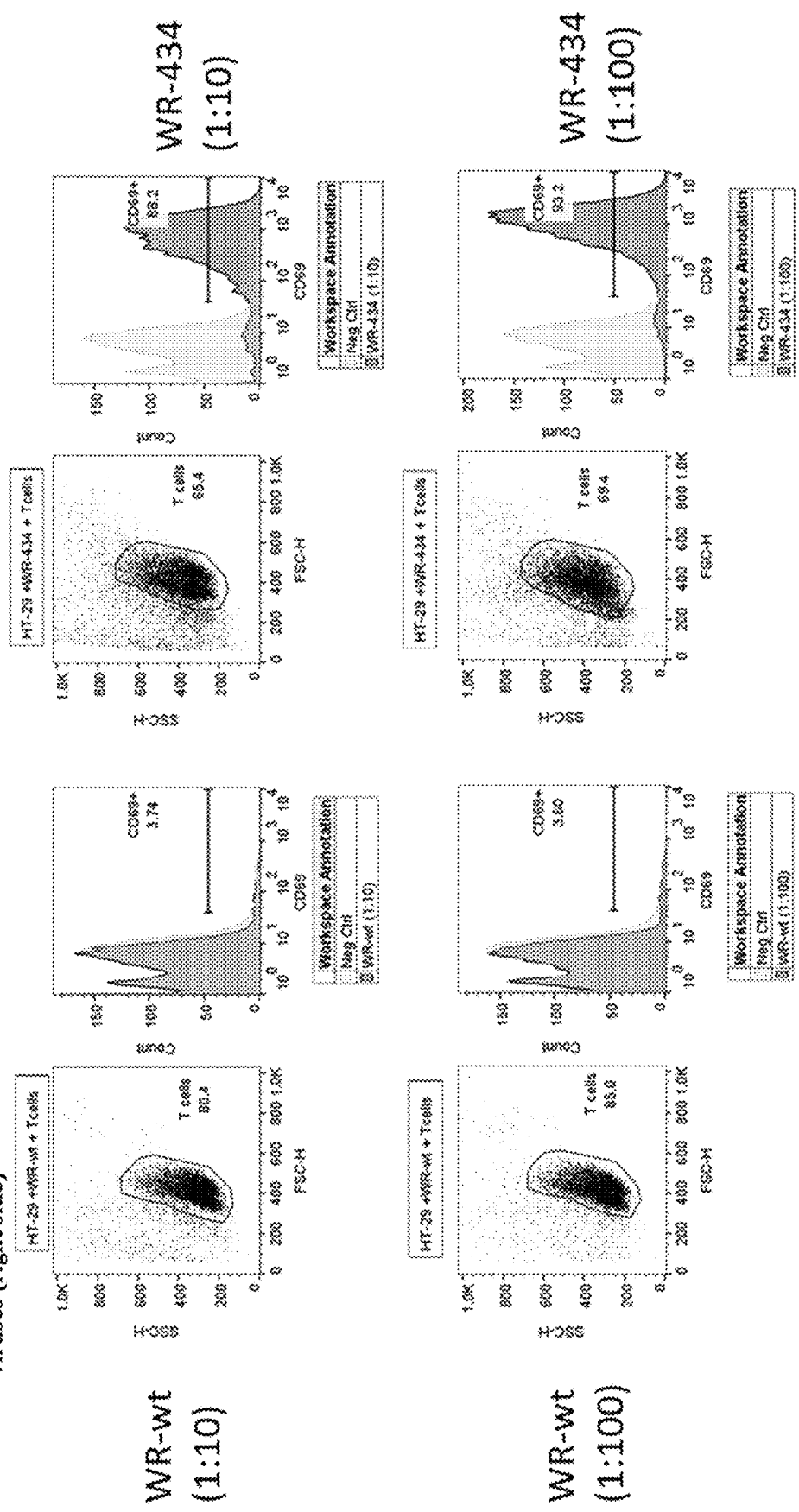
Figure 53A  Upregulation of CD69 by T cells exposed to SKOV cells infected with wild type viruses (left side) or transgene-expressing viruses (right side)

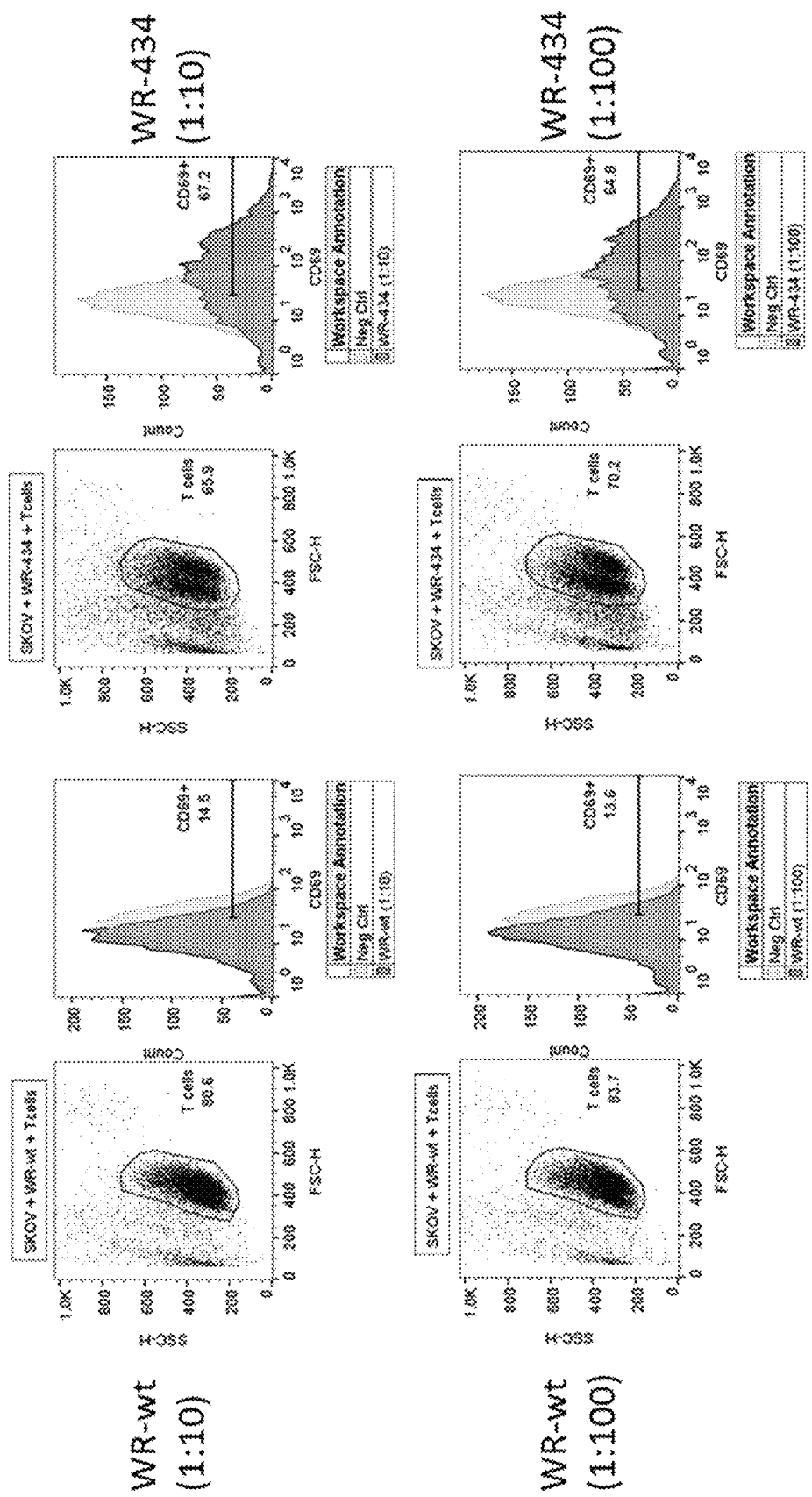
Figure 53B  Upregulation of CD69 by T cells exposed to SKOV cells infected with wild type viruses (left side) or transgene-expressing viruses (right side)

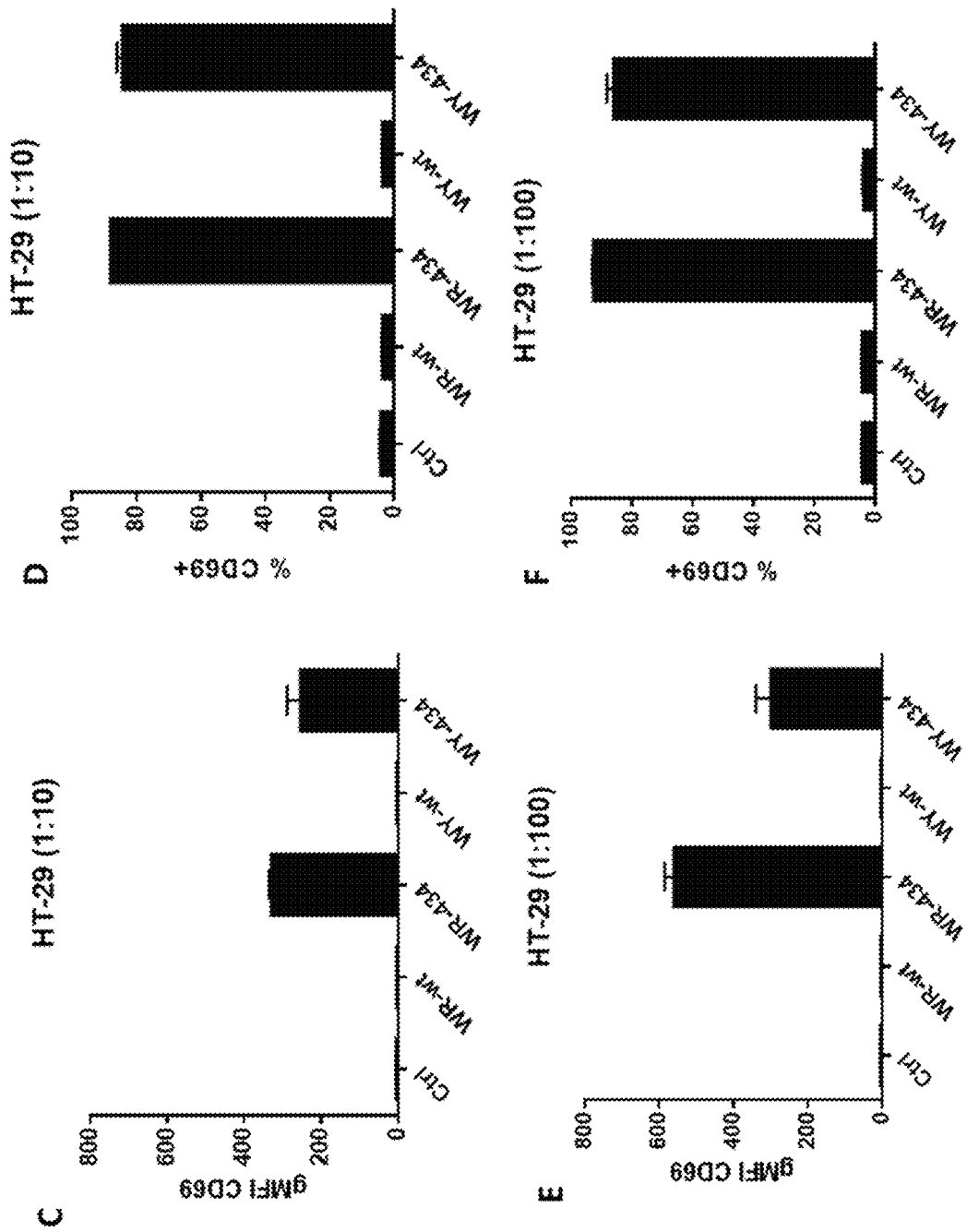
Figure 53C-F

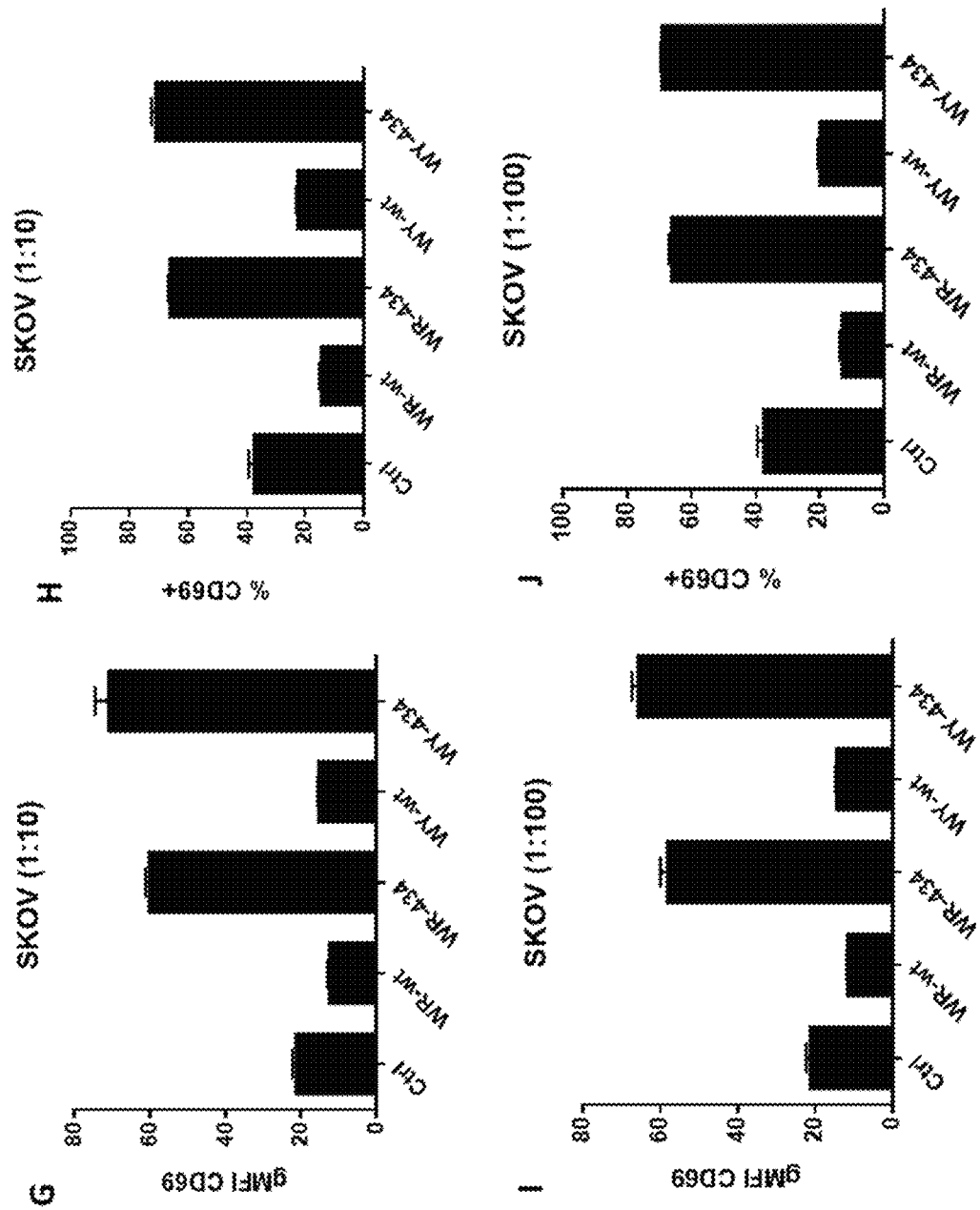
Figure 53G-J

Figure 58C
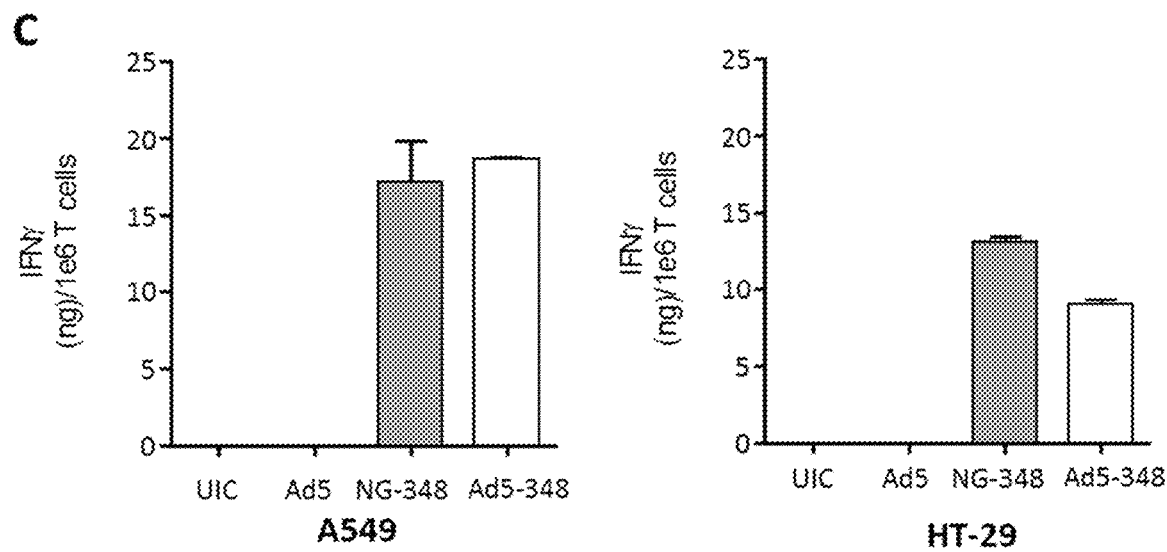
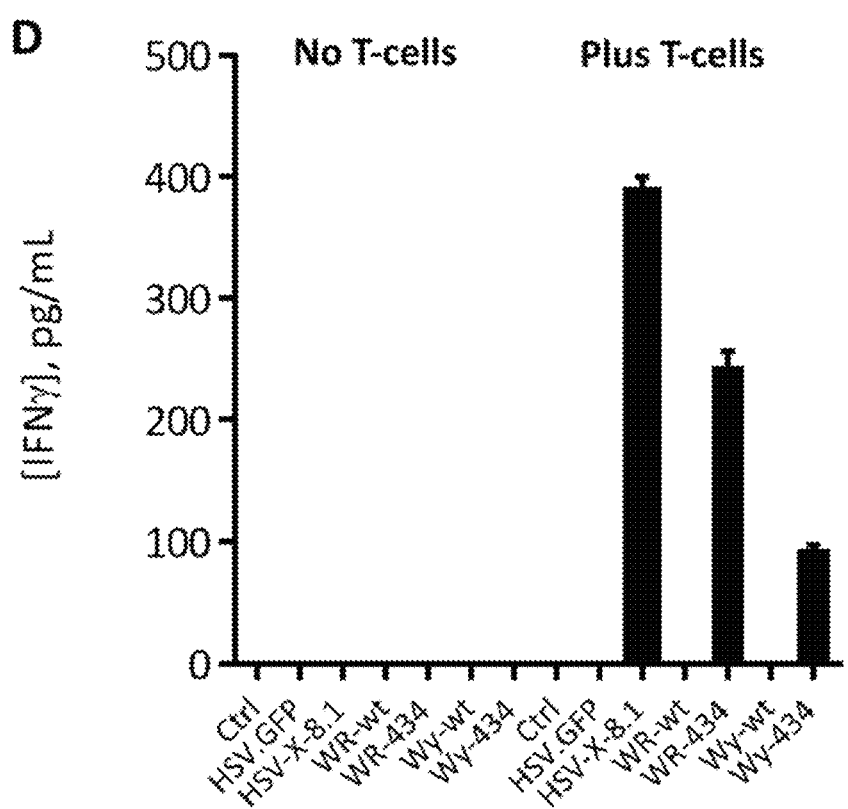

Figure 59

SEQ ID NO: 1 Muromonab-CD3 (OKT3) VH
QVQLQQSGAELARPGASVKMSCKASGYTFTRYTMHWVKQRPGQGLEWIGYINPSRGYTNYNQKFKDKAT
LTTDKSSSTAYMQLSSLTSEDSAVYYCARYYDDHYCLDYWGQGTTLTVSS

SEQ ID NO: 2 Muromonab-CD3 (OKT3) VL
DIVLTQSPAIMSASPGEKVTMTCSASSSVSYMNWYQQKSGTSPKRWIYDTSKLASGVPAHFRGSGSGTS
YSLTISGMEAEDAATYYCQQWSSNPFTFGSGTKLEINR

SEQ ID NO: 3 Muromonab –CD3 (OKT3) single chain Fv
QVQLQQSGAELARPGASVKMSCKASGYTFTRYTMHWVKQRPGQGLEWIGYINPSRGYTNYNQKFKDKAT
LTTDKSSSTAYMQLSSLTSEDSAVYYCARYYDDHYCLDYWGQGTTLTVSSGGGGSGGGGSGGGGSDIVL
TQSPAIMSASPGEKVTMTCSASSSVSYMNWYQQKSGTSPKRWIYDTSKLASGVPAHFRGSGSGTSYSLT
ISGMEAEDAATYYCQQWSSNPFTFGSGTKLEINR

SEQ ID NO: 4 Membrane anchored form of the anti-human CD3 single chain Fv
MGWSCIILFLVATATGVHSQVQLQQSGAELARPGASVKMSCKASGYTFTRYTMHWVKQRPGQGLEWIGY
INPSRGYTNYNQKFKDKATLTTDKSSSTAYMQLSSLTSEDSAVYYCARYYDDHYCLDYWGQGTTLTVSS
GGGGSGGGGSGGGGSDIVLTQSPAIMSASPGEKVTMTCSASSSVSYMNWYQQKSGTSPKRWIYDTSKLA
SGVPAHFRGSGSGTSYSLTISGMEAEDAATYYCQQWSSNPFTFGSGTKLEINRGSEQKLISEEDLNAVG
QDTQEVIVVPHSLPFKVVVISAILALVVLTIISLIILIMLWQKKPR

SEQ ID NO: 5 Membrane anchored form of anti-human CD3 single chain Fv with C-terminal V5 tag
MGWSCIILFLVATATGVHSQVQLQQSGAELARPGASVKMSCKASGYTFTRYTMHWVKQRPGQGLEWIGY
INPSRGYTNYNQKFKDKATLTTDKSSSTAYMQLSSLTSEDSAVYYCARYYDDHYCLDYWGQGTTLTVSS
GGGGSGGGGSGGGGSDIVLTQSPAIMSASPGEKVTMTCSASSSVSYMNWYQQKSGTSPKRWIYDTSKLA
SGVPAHFRGSGSGTSYSLTISGMEAEDAATYYCQQWSSNPFTFGSGTKLEINRGSEQKLISEEDLNAVG
QDTQEVIVVPHSLPFKVVVISAILALVVLTIISLIILIMLWQKKPRGSIPNPLLGLD  Tag in bold

SEQ ID NO: 6   Teplizumab VH sequence
QVQLVQSGGGVVQPGRSLRLSCKASGYTFTRYTMHWVRQAPGKGLEWIGYINPSRGYTNYNQKVKDRFT
ISRDNSKNTAFLQMDSLRPEDTGVYFCARYYDDHYCLDYWGQGTPVTVSS

Figure 60

SEQ ID NO: 7   Teplizumab VL sequence
DIQMTQSPSSLSASVGDRVTITCSASSSVSYMNWYQQTPGKAPKRWIYDTSKLASGVPSRFSGSGSGTD
YTFTISSLQPEDIATYYCQQWSSNPFTFGQGTKLQITR

SEQ ID NO: 8   Teplizumab Heavy chain sequence
QVQLVQSGGGVVQPGRSLRLSCKASGYTFTRYTMHWVRQAPGKGLEWIGYINPSRGYTNYNQKVKDRFT
ISRDNSKNTAFLQMDSLRPEDTGVYFCARYYDDHYCLDYWGQGTPVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPEAAGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKGQP
REPQVYTLPPSRDELTKNQVSLTCLVKGFYPSDIAVEWESNGQPENNYKTTPPVLDSDGSFFLYSKLTV
DKSRWQQGNVFSCSVMHEALHNHYTQKSLSLSPGK

SEQ ID NO: 9   Teplizumab Light Chain Sequence
DIQMTQSPSSLSASVGDRVTITCSASSSVSYMNWYQQTPGKAPKRWIYDTSKLASGVPSRFSGSGSGTD
YTFTISSLQPEDIATYYCQQWSSNPFTFGQGTKLQITRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKS
FNRGEC

SEQ ID NO: 15 PDGFR TM Domain
AVGQDTQEVIVVPHSLPFKVVVISAILALVVLTIISLIILIMLWQKKPR

SEQ ID NO: 18 PDGFR TM Domain with N-terminal c-myc tag
gsEQKLISEEDLnAVGQDTQEVIVVPHSLPFKVVVISAILALVVLTIISLIILIMLWQKKPR

Figure 61

SEQ ID NO: 19 HuVH human VH leader sequence
MGWSCIILFLVATATGVHS

SEQ ID NO. 21  EnAd Genome
TCTATCTATATAATATACCTTATAGATGGAATGGTGCCAATATGTAAATGAGGTGATTTTAAAAGTGT
GGATCGTGTGGTGATTGGCTGTGGGGTTAACGGCTAAAAGGGGCGGTGCGACCGTGGGAAAATGACGTT
TTGTGGGGGTGGAGTTTTTTGCAAGTTGTCGCGGGAAATGTGACGCATAAAAGGCTTTTTTCTCACG
GAACTACTTAGTTTTCCCACGGTATTTAACAGGAAATGAGGTAGTTTTGACCGGATGCAAGTGAAATT
GTTGATTTTCGCGCGAAAACTGAATGAGGAAGTGTTTTTCTGAATAATGTGGTATTTATGGCAGGGTGG
AGTATTTGTTCAGGGCCAGGTAGACTTTGACCCATTACGTGGAGGTTTCGATTACCGTGTTTTTACCT
GAATTTCCGCGTACCGTGTCAAAGTCTTCTGTTTTACGTAGGTGTCAGCTGATCGCTAGGGTATTTAT
ACCTCAGGGTTTGTGTCAAGAGGCCACTCTTGAGTGCCAGCGAGAAGAGTTTCTCCTCTGCGCCGGCA
GTTAATAATAAAAAATGAGAGATTTGCGATTTCTGCCTCAGGAAATAATCTCTGCTGAGACTGGAAA
TGAAATATTGGAGCTTGTGGTGCACGCCCTGATGGGAGACGATCCGGAGCCACCTGTGCAGCTTTTTGA
GCCTCCTACGCTTCAGGAACTGTATGATTTAGAGGTAGAGGGATCGGAGGATTCTAATGAGGAAGCTGT
AAATGGCTTTTTTACCGATTCTATGCTTTTAGCTGCTAATGAAGGGTTAGAATTAGATCCGCCTTTGGA
CACTTTTGATACTCCAGGGGTAATTGTGGAAAGCGGTACAGGTGTAAGAAAATTACCTGATTTGAGTTC
CGTGGACTGTGATTTGCACTGCTATGAAGACGGGTTTCCTCCGAGTGATGAGGAGGACCATGAAAAGGA
GCAGTCCATGCAGACTGCAGCGGGTGAGGGAGTGAAGGCTGCCAATGTTGGTTTTCAGTTGGATTGCCC
GGAGCTTCCTGGACATGGCTGTAAGTCTTGTGAATTTCACAGGAAAAATACTGGAGTAAAGGAACTGTT
ATGTTCGCTTTGTTATATGAGAACGCACTGCCACTTTATTTACAGTAAGTGTGTTTAAGTTAAAATTTA
AAGGAATATGCTGTTTTTCACATGTATATTGAGTGTGAGTTTTGTGCTTCTTATTATAGGTCCTGTGTC
TGATGCTGATGAATCACCATCTCCTGATTCTACTACCTCACCTCCTGAGATTCAAGCACCTGTTCCTGT
GGACGTGCGCAAGCCCATTCCTGTGAAGCTTAAGCCTGGGAAACGTCCAGCAGTGGAAAAACTTGAGGA
CTTGTTACAGGGTGGGGACGGACCTTTGGACTTGAGTACACGGAAACGTCCAAGACAATAAGTGTTCCA
TATCCGTGTTTACTTAAGGTGACGTCAATATTTGTGTGACAGTGCAATGTAATAAAAATATGTTAACTG
TTCACTGGTTTTTATTGCTTTTTGGGCGGGGACTCAGGTATATAAGTAGAAGCAGACCTGTGTGGTTAG
CTCATAGGAGCTGGCTTTCATCCATGGAGGTTTGGGCCATTTTGGAAGACCTTAGGAAGACTAGGCAAC
TGTTAGAGAACGCTTCGGACGGAGTCTCCGGTTTTTGGAGATTCTGGTTCGCTAGTGAATTAGCTAGGG
TAGTTTTTAGGATAAAACAGGACTATAAACAAGAATTTGAAAAGTTGTTGGTAGATTGCCCAGGACTTT
TTGAAGCTCTTAATTTGGGCCATCAGGTTCACTTTAAAGAAAAAGTTTTATCAGTTTTAGACTTTTCAA
CCCCAGGTAGAACTGCTGCTGCTGTGGCTTTTCTTACTTTTATATTAGATAAATGGATCCCGCAGACTC
ATTTCAGCAGGGGATACGTTTTGGATTTCATAGCCACAGCATTGTGGAGAACATGGAAGGTTCGCAAGA
TGAGGACAATCTTAGGTTACTGGCCAGTGCAGCCTTTGGGTGTAGCGGGAATCCTGAGGCATCCACCGG
TCATGCCAGCGGTTCTGGAGGAGGAACAGCAAGAGGACAACCCGAGAGCCGGCCTGGACCCTCCAGTGG
AGGAGGCGGAGTAGCTGACTTGTCTCCTGAACTGCAACGGGTGCTTACTGGATCTACGTCCACTGGACG
GGATAGGGGCGTTAAGAGGGAGAGGGCATCTAGTGGTACTGATGCTAGATCTGAGTTGGCTTTAAGTTT
AATGAGTCGCAGACGTCCTGAAACCATTTGGTGGCATGAGGTTCAGAAAGAGGGAAGGGATGAAGTTTC
TGTATTGCAGGAGAAATATTCACTGGAACAGGTGAAAACATGTTGGTTGGAGCCTGAGGATGATTGGGA
GGTGGCCATTAAAAATTATGCCAAGATAGCTTTGAGGCCTGATAAACAGTATAAGATTACTAGACGGAT
TAATATCCGGAATGCTTGTTACATATCTGGAAATGGGCTGAGGTGGTAATAGATACTCAAGACAAGGC
AGTTATTAGATGCTGCATGATGGATATGTGGCCTGGGGTAGTCGGTATGGAAGCAGTAACTTTTGTAAA
TGTTAAGTTTAGGGGAGATGGTTATAATGGAATAGTGTTTATGGCCAATACCAAACTTATATTGCATGG
TTGTAGCTTTTTTGGTTTCAACAATACCTGTGTAGATGCCTGGGGACAGGTTAGTGTACGGGGATGTAG
TTTCTATGCGTGTTGGATTGCCACAGCTGGCAGAACCAAGAGTCAATTGTCTCTGAAGAAATGCATATT
TCAAAGATGTAACCTGGGCATTCTGAATGAAGGCGAAGCAAGGGTCCGCCACTGCGCTTCTACAGATAC
TGGATGTTTTATTTTGATTAAGGGAAATGCCAGCGTAAAGCATAACATGATTTGCGGTGCTTCCGATGA
GAGGCCTTATCAAATGCTCACTTGTGCTGGTGGGCATTGTAATATGCTGGCTACTGTGCATATTGTTTC
CCATCAACGCAAAAAATGGCCTGTTTTTGATCACAATGTGATGACGAAGTGTACCATGCATGCAGGTGG
GCGTAGAGGAATGTTTATGCCTTACCAGTGTAACATGAATCATGTGAAAGTGTTGTTGGAACCAGATGC
CTTTTCCAGAATGAGCCTAACAGGAATTTTTGACATGAACATGCAAATCTGGAAGATCCTGAGGTATGA

Figure 61 continued

```
TGATACGAGATCGAGGGTACGCGCATGCGAATGCGGAGGCAAGCATGCCAGGTTCCAGCCGGTGTGTGT
AGATGTGACTGAAGATCTCAGACCGGATCATTTGGTTATTGCCCGCACTGGAGCAGAGTTCGGATCCAG
TGGAGAAGAAACTGACTAAGGTGAGTATTGGGAAAACTTTGGGGTGGGATTTTCAGATGGACAGATTGA
GTAAAAATTTGTTTTTTCTGTCTTGCAGCTGTCATGAGTGGAAACGCTTCTTTTAAGGGGGAGTCTTC
AGCCCTTATCTGACAGGGCGTCTCCCATCCTGGGCAGGAGTTCGTCAGAATGTTATGGGATCTACTGTG
GATGGAAGACCCGTCCAACCCGCCAATTCTTCAACGCTGACCTATGCTACTTTAAGTTCTTCACCTTTG
GACGCAGCTGCAGCTGCCGCCGCCGCTTCTGTTGCCGCTAACACTGTGCTTGGAATGGGTTACTATGGA
AGCATCATGGCTAATTCCACTTCCTCTAATAACCCTTCTACCCTGACTCAGGACAAGTTACTTGTCCTT
TTGGCCCAGCTGGAGGCTTTGACCCAACGTCTGGGTGAACTTTCTCAGCAGGTGGTCGAGTTGCGAGTA
CAAACTGAGTCTGCTGTCGGCACGGCAAAGTCTAAATAAAAAAATCCCAGAATCAATGAATAAATAAAC
AAGCTTGTTGTTGATTTAAAATCAAGTGTTTTTATTTCATTTTCGCGCACGGTATGCCCTAGACCACC
GATCTCTATCATTGAGAACTCGGTGGATTTTTCCAGGATCCTATAGAGGTGGGATTGAATGTTTAGAT
ACATGGGCATTAGGCCGTCTTTGGGGTGGAGATAGCTCCATTGAAGGGATTCATGCTCCGGGGTAGTGT
TGTAAATCACCCAGTCATAACAAGGTCGCAGTGCATGGTGTTGCACAATATCTTTTAGAAGTAGGCTGA
TTGCCACAGATAAGCCCTTGGTGTAGGTGTTTACAAACCGGTTGAGCTGGGATGGGTGCATTCGGGGTG
AAATTATGTGCATTTTGGATTGGATTTTAAGTTGGCAATATTGCCGCCAAGATCCCGTCTTGGGTTCA
TGTTATGAAGGACCACCAAGACGGTGTATCCGGTACATTTAGGAAATTTATCGTGCAGCTTGGATGGAA
AAGCGTGGAAAAATTTGGAGACACCCTTGTGTCCTCCAAGATTTTCCATGCACTCATCCATGATAATAG
CAATGGGCCGTGGGCAGCGGCGCGGGCAAACACGTTCCGTGGGTCTGACACATCATAGTTATGTTCCT
GAGTTAAATCATCATAAGCCATTTTAATGAATTTGGGGCGGAGAGTACCAGATTGGGGTATGAATGTTC
CTTCGGGCCCCGGAGCATAGTTCCCCTCACAGATTTGCATTTCCCAAGCTTTCAGTTCCGAGGGTGGAA
TCATGTCCACCTGGGGGGCTATGAAAAACACCGTTTCTGGGGCGGGGGTGATTAATTGTGATGATAGCA
AATTTCTGAGCAATTGAGATTTGCCACATCCGGTGGGGCCATAAATGATTCCGATTACGGGTTGCAGGT
GGTAGTTTAGGGAACGGCAACTGCCGTCTTCTCGAAGCAAGGGGGCCACCTCGTTCATCATTTCCCTTA
CATGCATATTTTCCCGCACCAAATCCATTAGGAGGCGCTCTCCTCCTAGTGATAGAAGTTCTTGTAGTG
AGGAAAAGTTTTTCAGCGGTTTCAGACCGTCAGCCATGGGCATTTTGGAGAGAGTTTGCTGCAAAAGTT
CTAGTCTGTTCCACAGTTCAGTGATGTGTTCTATGGCATCTCGATCCAGCAGACCTCCTCGTTTCGCGG
GTTTGGACGGCTCCTGGAATAGGGTATGAGACGATGGGCGTCCAGCGCTGCCAGGGTTCGGTCCTTCCA
GGGTCTCAGTGTTCGAGTCAGGGTTGTTTCCGTCACAGTGAAGGGGTGTGCGCCTGCTTGGGCGCTTGC
CAGGGTGCGCTTCAGACTCATCCTGCTGGTCGAAAACTTCTGTCGCTTGGCGCCCTGTATGTCGGCCAA
GTAGCAGTTTACCATGAGTTCGTAGTTGAGCGCCTCGGCTGCGTGGCCTTTGGCGCGGAGCTTACCTTT
GGAAGTTTTCTTGCATACCGGGCAGTATAGGCATTTCAGCGCATACAACTTGGGCGCAAGGAAAACGGA
TTCTGGGGAGTATGCATCTGCGCCGCAGGAGGCGCAAACAGTTTCACATTCCACCAGCCAGGTTAAATC
CGGTTCATTGGGGTCAAAAACAAGTTTTCCGCCATATTTTTGATGCGTTTCTTACCTTTGGTCTCCAT
GAGTTCGTGTCCTCGTTGAGTGACAAACAGGCTGTCCGTGTCCCCGTAGACTGATTTTACAGGCCTCTT
CTCCAGTGGAGTGCCTCGGTCTTCTTCGTACAGGAACTCTGACCACTCTGATACAAAGGCGCGCGTCCA
GGCCAGCACAAAGGAGGCTATGTGGGAGGGGTAGCGATCGTTGTCAACCAGGGGGTCCACCTTTTCCAA
AGTATGCAAACACATGTCACCCTCTTCAACATCCAGGAATGTGATTGGCTTGTAGGTGTATTTCACGTG
ACCTGGGGTCCCCGCTGGGGGGGTATAAAAGGGGCGGTTCTTTGCTCTTCCTCACTGTCTTCCGGATC
GCTGTCCAGGAACGTCAGCTGTTGGGTAGGTATTCCCTCTCGAAGGCGGGCATGACCTCTGCACTCAG
GTTGTCAGTTTCTAAGAACGAGGAGGATTTGATATTGACAGTGCCGGTTGAGATGCCTTTCATGAGGTT
TTCGTCCATCTGGTCAGAAAACACAATTTTTTATTGTCAAGTTTGGTGGCAAATGATCCATACAGGGC
GTTGGATAAAAGTTTGGCAATGGATCGCATGGTTTGGTTCTTTTCCTTGTCCGCGCGCTCTTTGGCGGC
GATGTTGAGTTGGACATACTCGCGTGCCAGGCACTTCCATTCGGGGAAGATAGTTGTTAATTCATCTGG
CACGATTCTCACTTGCCACCCTCGATTATGCAAGGTAATTAAATCCACACTGGTGGCCACCTCGCCTCG
AAGGGGTTCATTGGTCCAACAGAGCCTACCTCCTTTCCTAGAACAGAAAGGGGGAAGTGGGTCTAGCAT
AAGTTCATCGGGAGGGTCTGCATCCATGGTAAAGATTCCCGGAAGTAAATCCTTATCAAAATAGCTGAT
GGGAGTGGGGTCATCTAAGGCCATTTGCCATTCTCGAGCTGCCAGTGCGCGCTCATATGGGTTAAGGGG
ACTGCCCCATGGCATGGGATGGGTGAGTGCAGAGGCATACATGCCACAGATGTCATAGACGTAGATGGG
ATCCTCAAAGATGCCTATGTAGGTTGGATAGCATCGCCCCCTCTGATACTTGCTCGCACATAGTCATA
TAGTTCATGTGATGGCGCTAGCAGCCCCGGACCCAAGTTGGTGCGATTGGGTTTTTCTGTTCTGTAGAC
GATCTGGCGAAAGATGGCGTGAGAATTGGAAGAGATGGTGGGTCTTTGAAAAATGTTGAAATGGGCATG
```

Figure 61 continued

```
AGGTAGACCTACAGAGTCTCTGACAAAGTGGGCATAAGATTCTTGAAGCTTGGTTACCAGTTCGGCGGT
GACAAGTACGTCTAGGGCGCAGTAGTCAAGTGTTTCTTGAATGATGTCATAACCTGGTTGGTTTTTCTT
TTCCCACAGTTCGCGGTTGAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGGCAGCAGCCCTTCTC
TACGGGTAGAGAGTATGCTTGAGCAGCTTTTCGTAGCGAAGCGTGAGTAAGGGCAAAGGTGTCTCTGAC
CATGACTTTGAGGAATTGGTATTTGAAGTCGATGTCGTCACAGGCTCCCTGTTCCCAGAGTTGGAAGTC
TACCCGTTTCTTGTAGGCGGGGTTGGGCAAAGCGAAAGTAACATCATTGAAGAGAATCTTGCCGGCCCT
GGGCATGAAATTGCGAGTGATGCGAAAAGGCTGTGGTACTTCCGCTCGGTTATTGATAACCTGGGCAGC
TAGGACGATCTCGTCGAAACCGTTGATGTTGTGTCCTACGATGTATAATTCTATGAAACGCGGCGTGCC
TCTGACGTGAGGTAGCTTACTGAGCTCATCAAAGGTTAGGTCTGTGGGGTCAGATAAGGCGTAGTGTTC
GAGAGCCCATTCGTGCAGGTGAGGATTCGCTTTAAGGAAGGAGGACCAGAGGTCCACTGCCAGTGCTGT
TTGTAACTGGTCCCGGTACTGACGAAAATGCCGTCCGACTGCCATTTTTCTGGGGTGACGCAATAGAA
GGTTTGGGGGTCCTGCCGCCAGCGATCCCACTTGAGTTTATGGCGAGGTCATAGGCGATGTTGACGAG
CCGCTGGTCTCCAGAGAGTTTCATGACCAGCATGAAGGGGATTAGCTGCTTGCCAAAGGACCCCATCCA
GGTGTAGGTTTCCACATCGTAGGTGAGAAAGAGCCTTTCTGTGCAGGATGAGAGCCAATCGGGAAGAA
CTGGATCTCCTGCCACCAGTTGGAGGAATGGCTGTTGATGTGATGGAAGTAGAACTCCCTGCGACGCGC
CGAGCATTCATGCTTGTGCTTGTACAGACGGCCGCAGTAGTCGCAGCGTTGCACGGGTTGTATCTCGTG
AATGAGTTGTACCTGGCTTCCCTTGACGAGAAATTTCAGTGGGAAGCCGAGGCCTGGCGATTGTATCTC
GTGCTTTACTATGTTGTCTGCATCGGCCTGTTCATCTTCTGTCTCGATGGTGGTCATGCTGACGAGCCC
TCGCGGGAGGCAAGTCCAGACCTCGGCGCGGCAGGGGCGGAGCTCGAGGACGAGAGCGCGCAGGCTGGA
GCTGTCCAGGGTCCTGAGACGCTGCGGACTCAGGTTAGTAGGCAGTGTCAGGAGATTAACTTGCATGAT
CTTTTGGAGGGCGTGCGGGAGGTTCAGATAGTACTTGATCTCAACGGGTCCGTTGGTGGAGATGTCGAT
GGCTTGCAGGGTTCCGTGTCCCTTGGGCGCTACCACCGTGCCCTTGTTTTTCATTTTGGACGGCGGTGG
CTCTGTTGCTTCTTGCATGTTTAGAAGCGGTGTCGAGGGCGCGCACCGGGCGGCAGGGGCGGCTCGGGA
CCCGGCGGCATGGCTGGCAGTGGTACGTCGGCGCCGCGCGCGGGTAGGTTCTGGTACTGCGCCCTGAGA
AGACTCGCATGCGCGACGACGCGGCGGTTGACATCCTGGATCTGACGCCTCTGGGTGAAAGCTACCGGC
CCCGTGAGCTTGAACCTGAAAGAGAGTTCAACAGAATCAATCTCGGTATCGTTGACGGCGGCTTGCCTA
AGGATTTCTTGCACGTCACCAGAGTTGTCCTGGTAGGCGATCTCCGCCATGAACTGCTCGATCTCTTCC
TCTTGAAGATCTCCGCGGCCCGCTCTCGACGGTGGCCGCGAGGTCGTTGGAGATGCGCCCAATGAGT
TGAGAGAATGCATTCATGCCCGCCTCGTTCCAGACGCGGCTGTAGACCACGGCCCCCACGGGATCTCTC
GCGCGCATGACCACCTGGGCGAGGTTGAGCTCCACGTGGCGGGTGAAGACCGCATAGTTGCATAGGCGC
TGGAAAAGGTAGTTGAGTGTGGTGGCGATGTGCTCGGTGACGAAGAAATACATGATCCATCGTCTCAGC
GGCATCTCGCTGACATCGCCCAGAGCTTCCAAGCGCTCCATGGCCTCGTAGAAGTCCACGGCAAAATTA
AAAACTGGGAGTTTCGCGCGGACACGGTCAACTCCTCTTCCAGAAGACGGATAAGTTCGGCGATGGTG
GTGCGCACCTCGCGCTCGAAAGCCCCTGGGATTTCTTCCTCAATCTCTTCTTCTTCCACTAACATCTCT
TCCTCTTCAGGTGGGGCTGCAGGAGGAGGGGGAACGCGGCGACGCCGGCGGCGCACGGGCAGACGGTCG
ATGAATCTTTCAATGACCTCTCCGCGGCGGCGGCGCATGGTTTCAGTGACGGCGCGGCCGTTCTCGCGC
GGTCGCAGAGTAAAAACACCGCCGCGCATCTCCTTAAAGTGGTGACTGGGAGGTTCTCCGTTTGGGAGG
GAGAGGGCGCTGATTATACATTTTATTAATTGGCCCGTAGGGACTGCACGCAGAGATCTGATCGTGTCA
AGATCCACGGGATCTGAAAACCTTTCGACGAAAGCGTCTAACCAGTCACAGTCACAAGGTAGGCTGAGT
ACGGCTTCTTGTGGCGGGGTGGTTATGTGTTCGGTCTGGGTCTTCTGTTTCTTCTTCATCTCGGGAA
GGTGAGACGATGCTGCTGGTGATGAAATTAAAGTAGGCAGTTCTAAGACGGCGGATGGTGGCGAGGAGC
ACCAGGTCTTTGGGTCCGGCTTGCTGGATACGCAGGCGATTGGCCATTCCCCAAGCATTATCCTGACAT
CTAGCAAGATCTTTGTAGTAGTCTTGCATGAGCCGTTCTACGGGCACTTCTTCCTCACCCGTTCTGCCA
TGCATACGTGTGAGTCCAAATCCGCGCATTGGTTGTACCAGTGCCAAGTCAGCTACGACTCTTTCGGCG
AGGATGGCTTGCTGTACTTGGGTAAGGGTGGCTTGAAAGTCATCAAAATCCACAAAGCGGTGGTAAGCT
CCTGTATTAATGGTGTAAGCACAGTTGGCCATGACTGACCAGTTAACTGTCTGGTGACCAGGGCGCACG
AGCTCGGTGTATTTAAGGCGCGAATAGGCGCGGGTGTCAAAGATGTAATCGTTGCAGGTGCGCACCAGA
TACTGGTACCCTATAAGAAAATGCGGCGGTGGTTGGCGGTAGAGAGGCCATCGTTCTGTAGCTGGAGCG
CCAGGGGCGAGGTCTTCCAACATAAGGCGGTGATAGCCGTAGATGTACCTGGACATCCAGGTGATTCCT
GCGGCGGTAGTAGAAGCCCGAGGAAACTCGCGTACGCGGTTCCAAATGTTGCGTAGCGGCATGAAGTAG
TTCATTGTAGGCACGGTTTGACCAGTGAGGCGCGCGCAGTCATTGATGCTCTATAGACACGGAGAAAAT
```

Figure 61 continued

```
GAAAGCGTTCAGCGACTCGACTCCGTAGCCTGGAGGAACGTGAACGGGTTGGGTCGCGGTGTACCCCGG
TTCGAGACTTGTACTCGAGCCGGCCGGAGCCGCGGCTAACGTGGTATTGGCACTCCCGTCTCGACCCAG
CCTACAAAAATCCAGGATACGGAATCGAGTCGTTTGCTGGTTTCCGAATGGCAGGGAAGTGAGTCCTA
TTTTTTTTTTTGCCGCTCAGATGCATCCCGTGCTGCGACAGATGCGCCCCAACAACAGCCCCCCTCG
CAGCAGCAGCAGCAGCAATCACAAAAGGCTGTCCCTGCAACTACTGCAACTGCCGCCGTGAGCGGTGCG
GGACAGCCCGCCTATGATCTGGACTTGGAAGAGGGCGAAGGACTGGCACGTCTAGGTGCGCCTTCACCC
GAGCGGCATCCGCGAGTTCAACTGAAAAAGATTCTCGCGAGGCGTATGTGCCCCAACAGAACCTATTT
AGAGACAGAAGCGGCGAGGAGCCGGAGGAGATGCGAGCTTCCCGCTTTAACGCGGGTCGTGAGCTGCGT
CACGGTTTGGACCGAAGACGAGTGTTGCGGGACGAGGATTTCGAAGTTGATGAAATGACAGGGATCAGT
CCTGCCAGGGCACACGTGGCTGCAGCCAACCTTGTATCGGCTTACGAGCAGACAGTAAAGGAAGAGCGT
AACTTCCAAAAGTCTTTTAATAATCATGTGCGAACCCTGATTGCCCGCGAAGAAGTTACCCTTGGTTTG
ATGCATTTGTGGGATTTGATGGAAGCTATCATTCAGAACCCTACTAGCAAACCTCTGACCGCCCAGCTG
TTTCTGGTGGTGCAACACAGCAGAGACAATGAGGCTTTCAGAGAGGCGCTGCTGAACATCACCGAACCC
GAGGGGAGATGGTTGTATGATCTTATCAACATTCTACAGAGTATCATAGTGCAGGAGCGGAGCCTGGGC
CTGGCCGAGAAGGTGGCTGCCATCAATTACTCGGTTTTGAGCTTGGGAAAATATTACGCTCGCAAAATC
TACAAGACTCCATACGTTCCCATAGACAAGGAGGTGAAGATAGATGGGTTCTACATGCGCATGACGCTC
AAGGTCTTGACCCTGAGCGATGATCTTGGGGTGTATCGCAATGACAGAATGCATCGCGCGGTTAGCGCC
AGCAGGAGGCGCGAGTTAAGCGACAGGGAACTGATGCACAGTTTGCAAAGAGCTCTGACTGGAGCTGGA
ACCGAGGGTGAGAATTACTTCGACATGGGAGCTGACTTGCAGTGGCAGCCTAGTCGCAGGGCTCTGAGC
GCCGCGACGGCAGGATGTGAGCTTCCTTACATAGAAGAGGCGGATGAAGGCGAGGAGGAAGAGGGCGAG
TACTTGGAAGACTGATGGCACAACCCGTGTTTTTGCTAGATGGAACAGCAAGCACCGGATCCCGCAAT
GCGGGCGGCGCTGCAGAGCCAGCCGTCCGGCATTAACTCCTCGGACGATTGGACCCAGGCCATGCAACG
TATCATGGCGTTGACGACTCGCAACCCCGAAGCCTTTAGACAGCAACCCCAGGCCAACCGTCTATCGGC
CATCATGGAAGCTGTAGTGCCTTCCCGCTCTAATCCCACTCATGAGAAGGTCCTGGCCATCGTGAACGC
GTTGGTGGAGAACAAAGCTATTCGTCCAGATGAGGCCGGACTGGTATACAACGCTCTCTTAGAACGCGT
GGCTCGCTACAACAGTAGCAATGTGCAAACCAATTTGGACCGTATGATAACAGATGTACGCGAAGCCGT
GTCTCAGCGCGAAAGGTTCCAGCGTGATGCCAACCTGGGTTCGCTGGTGGCGTTAAATGCTTTCTTGAG
TACTCAGCCTGCTAATGTGCCGCGTGGTCAACAGGATTATACTAACTTTTTAAGTGCTTTGAGACTGAT
GGTATCAGAAGTACCTCAGAGCGAAGTGTATCAGTCCGGTCCTGATTACTTCTTTCAGACTAGCAGACA
GGGCTTGCAGACGGTAAATCTGAGCCAAGCTTTTAAAAACCTTAAAGGTTTGTGGGGAGTGCATGCCCC
GGTAGGAGAAAGAGCAACCGTGTCTAGCTTGTTAACTCCGAACTCCCGCCTATTATTACTGTTGGTAGC
TCCTTTCACCGACAGCGGTAGCATCGACCGTAATTCCTATTTGGGTTACCTACTAAACCTGTATCGCGA
AGCCATAGGGCAAAGTCAGGTGGACGAGCAGACCTATCAAGAAATTACCCAAGTCAGTCGCGCTTTGGG
ACAGGAAGACACTGGCAGTTTGGAAGCCACTCTGAACTTCTTGCTTACCAATCGGTCTCAAAAGATCCC
TCCTCAATATGCTCTTACTGCGGAGGAGGAGAGGATCCTTAGATATGTGCAGCAGAGCGTGGGATTGTT
TCTGATGCAAGAGGGGGCAACTCCGACTGCAGCACTGGACATGACAGCGCGAAATATGGAGCCCAGCAT
GTATGCCAGTAACCGACCTTTCATTAACAAACTGCTGGACTACTTGCACAGAGCTGCCGCTATGAACTC
TGATTATTTCACCAATGCCATCTTAAACCCGCACTGGCTGCCCCACCTGGTTTCTACACGGGCGAATA
TGACATGCCCGACCCTAATGACGGATTTCTGTGGGACGACGTGGACAGCGATGTTTTTCACCTCTTTC
TGATCATCGCACGTGGAAAAGGAAGGCGGCGATAGAATGCATTCTTCTGCATCGCTGTCCGGGGTCAT
GGGTGCTACCGCGGCTGAGCCCGAGTCTGCAAGTCCTTTTCCTAGTCTACCCTTTTCTCTACACAGTGT
ACGTAGCAGCGAAGTGGGTAGAATAAGTCGCCCGAGTTTAATGGGCGAAGAGGAGTATCTAAACGATTC
CTTGCTCAGACCGGCAAGAGAAAAAAATTTCCCAAACAATGGAATAGAAAGTTTGGTGGATAAAATGAG
TAGATGGAAGACTTATGCTCAGGATCACAGAGACGAGCCTGGGATCATGGGATTACAAGTAGAGCGAG
CCGTAGACGCCAGCGCCATGACAGACAGAGGGGTCTTGTGTGGGACGATGAGGATTCGGCCGATGATAG
CAGCGTGCTGGACTTGGGTGGGAGAGGAAGGGGCAACCCGTTTGCTCATTTGCGCCCTCGCTTGGGTGG
TATGTTGTAAAAAAAAATAAAAAAAAAACTCACCAAGGCCATGGCGACGAGCGTACGTTCGTTCTTCTT
TATTATCTGTGTCTAGTATAATGAGGCGAGTCGTGCTAGGCGGAGCGGTGGTGTATCCGGAGGGTCCTC
CTCCTTCGTACGAGAGCGTGATGCAGCAGCAGCAGGCGACGGCGGTGATGCAATCCCCACTGGAGGCTC
CCTTTGTGCCTCCGCGATACCTGGCACCTACGGAGGGCAGAAACAGCATTCGTTATTCGGAACTGGCAC
CTCAGTACGATACCACCAGGTTGTATCTGGTGGACAACAAGTCGGCGGACATTGCTTCTCTGAACTATC
AGAATGACCACAGCAACTTCTTGACCACGGTGGTGCAAAACAATGACTTTACCCCTACGGAAGCCAGCA
```

Figure 61 continued

```
CCCAGACCATTAACTTTGATGAACGATCGCGGTGGGGCGGTCAGCTAAAGACCATCATGCATACTAACA
TGCCAAACGTGAACGAGTATATGTTTAGTAACAAGTTCAAAGCGCGTGTGATGGTGTCCAGAAAACCTC
CCGACGGTGCTGCAGTTGGGGATACTTATGATCACAAGCAGGATATTTTGAAATATGAGTGGTTCGAGT
TTACTTTGCCAGAAGGCAACTTTTCAGTTACTATGACTATTGATTTGATGAACAATGCCATCATAGATA
ATTACTTGAAAGTGGGTAGACAGAATGGAGTGCTTGAAAGTGACATTGGTGTTAAGTTCGACACCAGGA
ACTTCAAGCTGGGATGGGATCCCGAAACCAAGTTGATCATGCCTGGAGTGTATACGTATGAAGCCTTCC
ATCCTGACATTGTCTTACTGCCTGGCTGCGGAGTGGATTTTACCGAGAGTCGTTTGAGCAACCTTCTTG
GTATCAGAAAAAAACAGCCATTTCAAGAGGGTTTTAAGATTTTGTATGAAGATTTAGAAGGTGGTAATA
TTCCGGCCCTCTTGGATGTAGATGCCTATGAGAACAGTAAGAAGAACAAAAAGCCAAAATAGAAGCTG
CTACAGCTGCTGCAGAAGCTAAGGCAAACATAGTTGCCAGCGACTCTACAAGGGTTGCTAACGCTGGAG
AGGTCAGAGGAGACAATTTTGCGCCAACACCTGTTCCGACTGCAGAATCATTATTGGCCGATGTGTCTG
AAGGAACGGACGTGAAACTCACTATTCAACCTGTAGAAAAGATAGTAAGAATAGAAGCTATAATGTGT
TGGAAGACAAAATCAACACAGCCTATCGCAGTTGGTATCTTTCGTACAATTATGGCGATCCCGAAAAAG
GAGTGCGTTCCTGGACATTGCTCACCACCTCAGATGTCACCTGCGGAGCAGAGCAGGTCTACTGGTCGC
TTCCAGACATGATGAAGGATCCTGTCACTTTCCGCTCCACTAGACAAGTCAGTAACTACCCTGTGGTGG
GTGCAGAGCTTATGCCCGTCTTCTCAAAGAGCTTCTACAACGAACAAGCTGTGTACTCCCAGCAGCTCC
GCCAGTCCACCTCGCTTACGCACGTCTTCAACCGCTTTCCTGAGAACCAGATTTTAATCCGTCCGCCGG
CGCCCACCATTACCACCGTCAGTGAAAACGTTCCTGCTCTCACAGATCACGGGACCCTGCCGTTGCGCA
GCAGTATCCGGGGAGTCCAACGTGTGACCGTTACTGACGCCAGACGCCGCACCTGTCCCTACGTGTACA
AGGCACTGGGCATAGTCGCACCGCGCGTCCTTTCAAGCCGCACTTTCTAAAAAAAAAAAAAAATGTCCAT
TCTTATCTCGCCCAGTAATAACACCGGTTGGGGTCTGCGCGCTCCAAGCAAGATGTACGGAGGCGCACG
CAAACGTTCTACCCAACATCCTGTCCGTGTTCGCGGACATTTTCGCGCTCCATGGGGCGCCCTCAAGGG
CCGCACTCGCGTTCGAACCACCGTCGATGATGTAATCGATCAGGTGGTTGCCGACGCCCGTAATTATAC
TCCTACTGCGCCTACATCTACTGTGGATGCAGTTATTGACAGTGTAGTGGCTGACGCTCGCAACTATGC
TCGACGTAAGAGCCGGCGAAGGCGCATTGCCAGACGCCACCGAGCTACCACTGCCATGCGAGCCGCAAG
AGCTCTGCTACGAAGAGCTAGACGCGTGGGGCGAAGAGCCATGCTTAGGGCGGCCAGACGTGCAGCTTC
GGGCGCCAGCGCCGGCAGGTCCCGCAGGCAAGCAGCCGCTGTCGCAGCGGCGACTATTGCCGACATGGC
CCAATCGCGAAGAGGCAATGTATACTGGGTGCGTGACGCTGCCACCGGTCAACGTGTACCCGTGCGCAC
CCGTCCCCCTCGCACTTAGAAGATACTGAGCAGTCTCCGATGTTGTGTCCCAGCGGCGAGGATGTCCAA
GCGCAAATACAAGGAAGAAATGCTGCAGGTTATCGCACCTGAAGTCTACGGCCAACCGTTGAAGGATGA
AAAAAAACCCCGCAAAATCAAGCGGGTTAAAAAGGACAAAAAGAAGAGGAAGATGGCGATGATGGGCT
GGCGGAGTTTGTGCGCGAGTTTGCCCCACGGCGACGCGTGCAATGGCGTGGGCGCAAAGTTCGACATGT
GTTGAGACCTGGAACTTCGGTGGTCTTTACACCCGGCGAGCGTTCAAGCGCTACTTTTAAGCGTTCCTA
TGATGAGGTGTACGGGGATGATGATATTCTTGAGCAGGCGGCTGACCGATTAGGCGAGTTTGCTTATGG
CAAGCGTAGTAGAATAACTTCCAAGGATGAGACAGTGTCGATACCCTTGGATCATGGAAATCCCACCCC
TAGTCTTAAACCGGTCACTTTGCAGCAAGTGTTACCCGTAACTCCGCGAACAGGTGTTAAACGCGAAGG
TGAAGATTTGTATCCCACTATGCAACTGATGGTACCCAAACGCCAGAAGTTGGAGGACGTTTTGGAGAA
AGTAAAAGTGGATCCAGATATTCAACCTGAGGTTAAAGTGAGACCCATTAAGCAGGTAGCGCCTGGTCT
GGGGGTACAAACTGTAGACATTAAGATTCCCACTGAAAGTATGGAAGTGCAAACTGAACCCGCAAAGCC
TACTGCCACCTCCACTGAAGTGCAAACGGATCCATGGATGCCCATGCCTATTACAACTGACGCCGCCGG
TCCCACTCGAAGATCCCGACGAAAGTACGGTCCAGCAAGTCTGTTGATGCCCAATTATGTTGTACACCC
ATCTATTATTCCTACTCCTGGTTACCGAGGCACTCGCTACTATCGCAGCCGAAACAGTACCTCCCGCCG
TCGCCGCAAGACACCTGCAAATCGCAGTCGTCGCCGTAGACGCACAAGCAAACCGACTCCCGGCGCCCT
GGTGCGGCAAGTGTACCGCAATGGTAGTGCGGAACCTTTGACACTGCCGCGTGCGCGTTACCATCCGAG
TATCATCACTTAATCAATGTTGCCGCTGCCTCCTTGCAGATATGGCCCTCACTTGTCGCCTTCGCGTTC
CCATCACTGGTTACCGAGGAAGAAACTCGCGCCGTAGAAGAGGGATGTTGGGACGCGGAATGCGACGCT
ACAGGCGACGGCGTGCTATCCGCAAGCAATTGCGGGGTGGTTTTTTACCAGCCTTAATTCCAATTATCG
CTGCTGCAATTGGCGCGATACCAGGCATAGCTTCCGTGGCGGTTCAGGCCTCGCAACGACATTGACATT
GGAAAAAACGTATAAATAAAAAAAAAAAATACAATGGACTCTGACACTCCTGGTCCTGTGACTATGT
TTTCTTAGAGATGGAAGACATCAATTTTTCATCCTTGGCTCCGCGACACGGCACGAAGCCGTACATGGG
CACCTGGAGCGACATCGGCACGAGCCAACTGAACGGGGCGCCTTCAATTGGAGCAGTATCTGGAGCGG
GCTTAAAAATTTTGGCTCAACCATAAAAACATACGGGAACAAAGCTTGGAACAGCAGTACAGGACAGGC
```

Figure 61 continued

```
GCTTAGAAATAAACTTAAAGACCAGAACTTCCAACAAAAAGTAGTCGATGGGATAGCTTCCGGCATCAA
TGGAGTGGTAGATTTGGCTAACCAGGCTGTGCAGAAAAGATAAACAGTCGTTTGGACCCGCCGCCAGC
AACCCCAGGTGAAATGCAAGTGGAGGAAGAAATTCCTCCGCCAGAAAAACGAGGCGACAAGCGTCCGCG
TCCCGATTTGGAAGAGACGCTGGTGACGCGCGTAGATGAACCGCCTTCTTATGAGGAAGCAACGAAGCT
TGGAATGCCCACCACTAGACCGATAGCCCCAATGGCCACCGGGGTGATGAAACCTTCTCAGTTGCATCG
ACCCGTCACCTTGGATTTGCCCCCTCCCCCTGCTGCTACTGCTGTACCCGCTTCTAAGCCTGTCGCTGC
CCCGAAACCAGTCGCCGTAGCCAGGTCACGTCCCGGGGCGCTCCTCGTCCAAATGCGCACTGGCAAAA
TACTCTGAACAGCATCGTGGGTCTAGGCGTGCAAAGTGTAAAACGCCGTCGCTGCTTTTAATTAAATAT
GGAGTAGCGCTTAACTTGCCTATCTGTGTATATGTGTCATTACACGCCGTCACAGCAGCAGAGGAAAAA
AGGAAGAGGTCGTGCGTCGACGCTGAGTTACTTTCAAGATGGCCACCCCATCGATGCTGCCCCAATGGG
CATACATGCACATCGCCGGACAGGATGCTTCGGAGTACCTGAGTCCGGGTCTGGTGCAGTTCGCCCGCG
CCACAGACACCTACTTCAATCTGGGAAATAAGTTTAGAAATCCCACCGTAGCGCCGACCCACGATGTGA
CCACCGACCGTAGCCAGCGGCTCATGTTGCGCTTCGTGCCCGTTGACCGGGAGGACAATACATACTCTT
ACAAAGTGCGGTACACCCTGGCCGTGGGCGACAACAGAGTGCTGGATATGGCCAGCACGTTCTTTGACA
TTAGGGGTGTGTTGGACAGAGGTCCCAGTTTCAAACCCTATTCTGGTACGGCTTACAACTCCCTGGCTC
CTAAAGGCGCTCCAAATACATCTCAGTGGATTGCAGAAGGTGTAAAAAATACAACTGGTGAGGAACACG
TAACAGAAGAGGAAACCAATACTACTACTTACACTTTTGGCAATGCTCCTGTAAAAGCTGAAGCTGAAA
TTACAAAAGAAGGACTCCCAGTAGGTTTGGAAGTTTCAGATGAAGAAAGTAAACCGATTTATGCTGATA
AACATATCAGCCAGAACCTCAGCTGGGAGATGAAACTTGGACTGACCTTGATGGAAAAACCGAAAAGT
ATGGAGGCAGGGCTCTCAAACCCGATACTAAGATGAAACCATGCTACGGGTCCTTTGCCAAACCTACTA
ATGTGAAAGGCGGTCAGGCAAAACAAAAACAACGGAGCAGCCAAATCAGAAAGTCGAATATGATATCG
ACATGGAGTTTTTTGATGCGGCATCGCAGAAAACAAACTTAAGTCCTAAAATTGTCATGTATGCAGAAA
ATGTAAATTTGGAAACTCCAGACACTCATGTAGTGTACAAACCTGGAACAGAAGACACAAGTTCCGAAG
CTAATTTGGGACAACAATCTATGCCCAACAGACCCAACTACATTGGCTTCAGAGATAACTTTATTGGAC
TTATGTACTATAACAGTACTGGTAACATGGGGGTGCTGGCTGGTCAAGCGTCTCAGTTAAATGCAGTGG
TTGACTTGCAGGACAGAAACACAGAACTTTCTTACCAACTCTTGCTTGACTCTCTGGGCGACAGAACCA
GATACTTTAGCATGTGGAATCAGGCTGTGGACAGTTATGATCCTGATGTACGTGTTATTGAAAATCATG
GTGTGGAAGATGAACTTCCCAACTACTGTTTTCCACTGGACGGCATAGGTGTTCCAACAACCAGTTACA
AATCAATAGTTCCAAATGGAGACAATGCGCCTAATTGGAAGGAACCTGAAGTAAATGGAACAAGTGAGA
TCGGACAGGGTAATTTGTTTGCCATGGAAATTAACCTTCAAGCCAATCTATGGCGAAGTTTCCTTTATT
CCAATGTGGCTCTATATCTCCCAGACTCGTACAAATACACCCCGTCCAATGTCACTCTTCCAGAAAACA
AAAACACCTACGACTACATGAACGGGCGGGTGGTGCCGCCATCTCTAGTAGACACCTATGTGAACATTG
GTGCCAGGTGGTCTCTGGATGCCATGGACAATGTCAACCCATTCAACCACCACCGTAACGCTGGCTTGC
GTTACCGATCCATGCTTCTGGGTAACGGACGTTATGTGCCTTTCCACATACAAGTGCCTCAAAAATTCT
TCGCTGTTAAAAACCTGCTGCTTCTCCCAGGCTCCTACACTTATGAGTGGAACTTTAGGAAGGATGTGA
ACATGGTTCTACAGAGTTCCCTCGGTAACGACCTGCGGGTAGATGGCGCCAGCATCAGTTTCACGAGCA
TCAACCTCTATGCTACTTTTTTCCCCATGGCTCACAACACCGCTTCCACCCTTGAAGCCATGCTGCGGA
ATGACACCAATGATCAGTCATTCAACGACTACCTATCTGCAGCTAACATGCTCTACCCCATTCCTGCCA
ATGCAACCAATATTCCCATTTCCATTCCTTCTCGCAACTGGGCGGCTTTCAGAGGCTGGTCATTTACCA
GACTGAAAACCAAAGAAACTCCCTCTTTGGGGTCTGGATTTGACCCCTACTTTGTCTATTCTGGTTCTA
TTCCCTACCTGGATGGTACCTTCTACCTGAACCACACTTTTAAGAAGGTTTCCATCATGTTTGACTCTT
CAGTGAGCTGGCCTGGAAATGACAGGTTACTATCTCCTAACGAATTTGAAATAAAGCGCACTGTGGATG
GCGAAGGCTACAACGTAGCCCAATGCAACATGACCAAAGACTGGTTCTTGGTACAGATGCTCGCCAACT
ACAACATCGGCTATCAGGGCTTCTACATTCCAGAAGGATACAAAGATCGCATGTATTCATTTTTCAGAA
ACTTCCAGCCCATGAGCAGGCAGGTGGTTGATGAGGTCAATTACAAAGACTTCAAGGCCGTCGCCATAC
CCTACCAACACAACAACTCTGGCTTTGTGGGTTACATGGCTCCGACCATGCGCCAAGGTCAACCCTATC
CCGCTAACTATCCCTATCCACTCATTGGAACAACTGCCGTAAATAGTGTTACGCAGAAAAAGTTCTTGT
GTGACAGAACCATGTGGCGCATACCGTTCTCGAGCAACTTCATGTCTATGGGGCCCTTACAGACTTGG
GACAGAATATGCTCTATGCCAACTCAGCTCATGCTCTGGACATGACCTTTGAGGTGGATCCCATGGATG
AGCCCACCCTGCTTTATCTTCTCTTCGAAGTTTTCGACGTGGTCAGAGTGCATCAGCCACACCGCGGCA
TCATCGAGGCAGTCTACCTGCGTACACCGTTCTCGGCCGGTAACGCTACCACGTAAGAAGCTTCTTGCT
TCTTGCAAATAGCAGCTGCAACCATGGCCTGCGGATCCCAAAACGGCTCCAGCGAGCAAGAGCTCAGAG
```

Figure 61 continued

```
CCATTGTCCAAGACCTGGGTTGCGGACCCTATTTTTGGGAACCTACGATAAGCGCTTCCCGGGGTTCA
TGGCCCCCGATAAGCTCGCCTGTGCCATTGTAAATACGGCCGGACGTGAGACGGGGGGAGAGCACTGGT
TGGCTTTCGGTTGGAACCCACGTTCTAACACCTGCTACCTTTTGATCCTTTTGGATTCTCGGATGATC
GTCTCAAACAGATTTACCAGTTTGAATATGAGGGTCTCCTGCGCCGCAGCGCTCTTGCTACCAAGGACC
GCTGTATTACGCTGGAAAAATCTACCCAGACCGTGCAGGGTCCCCGTTCTGCCGCCTGCGGACTTTCT
GCTGCATGTTCCTTCACGCCTTTGTGCACTGGCCTGACCGTCCCATGGACGGAAACCCCACCATGAAAT
TGCTAACTGGAGTGCCAAACAACATGCTTCATTCTCCTAAAGTCCAGCCCACCCTGTGTGACAATCAAA
AAGCACTCTACCATTTTCTTAATACCCATTCGCCTTATTTTCGCTCCCATCGTACACATCGAAAGGG
CCACTGCGTTCGACCGTATGGATGTTCAATAATGACTCATGTAAACAACGTGTTCAATAAACATCACTT
TATTTTTTTACATGTATCAAGGCTCTGCATTACTTATTTATTTACAAGTCGAATGGGTTCTGACGAGAA
TCAGAATGACCCGCAGGCAGTGATACGTTGCGGAACTGATACTTGGGTTGCCACTTGAATTCGGGAATC
ACCAACTTGGGAACCGGTATATCGGGCAGGATGTCACTCCACAGCTTTCTGGTCAGCTGCAAAGCTCCA
AGCAGGTCAGGAGCCGAAATCTTGAAATCACAATTAGGACCAGTGCTTTGAGCGCGAGAGTTGCGGTAC
ACCGGATTGCAGCACTGAAACACCATCAGCGACGGATGTCTCACGCTTGCCAGCACGGTGGGATCTGCA
ATCATGCCCACATCCAGATCTTCAGCATTGGCAATGCTGAACGGGGTCATCTTGCAGGTCTGCCTACCC
ATGGCGGCACCCAATTAGGCTTGTGGTTGCAATCGCAGTGCAGGGGATCAGTATCATCTTGGCCTGA
TCCTGTCTGATTCCTGGATACACGGCTCTCATGAAAGCATCATATTGCTTGAAAGCCTGCTGGGCTTTA
CTACCCTCGGTATAAAACATCCCGCAGGACCTGCTCGAAAACTGGTTAGCTGCACAGCCGGCATCATTC
ACACAGCAGCGGGCGTCATTGTTAGCTATTTGCACCACACTTCTGCCCCAGCGGTTTTGGGTGATTTG
GTTCGCTCGGGATTCTCCTTTAAGGCTCGTTGTCCGTTCTCGCTGGCCACATCCATCTCGATAATCTGC
TCCTTCTGAATCATAATATTGCCATGCAGGCACTTCAGCTTGCCCTCATAATCATTGCAGCCATGAGGC
CACAACGCACAGCCTGTACATTCCCAATTATGGTGGGCGATCGAGAAAAGAATGTATCATTCCCTGC
AGAAATCTTCCCATCATCGTGCTCAGTGTCTTGTGACTAGTGAAAGTTAACTGGATGCCTCGGTGCTCC
TCGTTTACGTACTGGTGACAGATGCGCTTGTATTGTTCGTGTTGCTCAGGCATTAGTTTAAAAGAGGTT
CTAAGTTCGTTATCCAGCCTGTACTTCTCCATCAGCAGACACATCACTTCCATGCCTTTCTCCCAAGCA
GACACCAGGGGCAAGCTAATCGGATTCTTAACAGTGCAGGCAGCAGCTCCTTTAGCCAGAGGGTCATCT
TTAGCGATCTTCTCAATGCTTCTTTTGCCATCCTTCTCAACGATGCGCACGGGCGGGTAGCTGAAACCC
ACTGCTACAAGTTGCGCCTCTTCTCTTTCTTCTTCGCTGTCTTGACTGATGTCTTGCATGGGGATATGT
TTGGTCTTCCTTGGCTTCTTTTTGGGGGTATCGGAGGAGGAGGACTGTCGCTCCGTTCCGGAGACAGG
GAGGATTGTGACGTTTCGCTCACCATTACCAACTGACTGTCGGTAGAAGAACCTGACCCCACACGGCGA
CAGGTGTTTCTCTTCGGGGGCAGAGGTGGAGGCGATTGCGAAGGGCTGCGGTCCGACCTGGAAGGCGGA
TGACTGGCAGAACCCCTTCCGCGTTCGGGGTGTGCTCCCTGTGGCGGTCGCTTAACTGATTTCCTTCG
CGGCTGGCCATTGTGTTCTCCTAGGCAGAGAAACAACAGACATGGAAACTCAGCCATTGCTGTCAACAT
CGCCACGAGTGCCATCACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATGACATGCAGAATAAAA
AAGCGAAAGAGTCTGAGACAGACATCGAGCAAGACCCGGGCTATGTGACACCGGTGGAACACGAGGAAG
AGTTGAAACGCTTTCTAGAGAGAGAGGATGAAAACTGCCCAAAACAACGAGCAGATAACTATCACCAAG
ATGCTGGAAATAGGGATCAGAACACCGACTACCTCATAGGGCTTGACGGGGAAGACGCGCTCCTTAAAC
ATCTAGCAAGACAGTCGCTCATAGTCAAGGATGCATTATTGGACAGAACTGAAGTGCCCATCAGTGTGG
AAGAGCTCAGCCGCGCCTACGAGCTTAACCTCTTTTCACCTCGTACTCCCCCAAACGTCAGCCAAACG
GCACCTGCGAGCCAAATCCTCGCTTAAACTTTTATCCAGCTTTTGCTGTGCCAGAAGTACTGGCTACCT
ATCACATCTTTTTTAAAAATCAAAAAATTCCAGTCTCCTGCCGCGCTAATCGCACCCGCGCCGATGCCC
TACTCAATCTGGGACCTGGTTCACGCTTACCTGATATAGCTTCCTTGGAAGAGGTTCCAAAGATCTTCG
AGGGTCTGGGCAATAATGAGACTCGGGCCGCAAATGCTCTGCAAAAGGGAGAAAATGGCATGGATGAGC
ATCACAGCGTTCTGGTGGAATTGGAAGGCGATAATGCCAGACTCGCAGTACTCAAGCGAAGCATCGAGG
TCACACACTTCGCATATCCCGCTGTCAACCTGCCCCTAAAGTCATGACGGCGGTCATGGACCAGTTAC
TCATTAAGCGCGCAAGTCCCCTTTCAGAAGACATGCATGACCCAGATGCCTGTGATGAGGGTAAACCAG
TGGTCAGTGATGAGCAGCTAACCCGATGGCTGGGCACCGACTCTCCCAGGGATTTGGAAGAGCGTCGCA
AGCTTATGATGGCCGTGGTGCTGGTTACCGTAGAACTAGAGTGTCTCCGACGTTTCTTTACCGATTCAG
AAACCTTGCGCAAACTCGAAGAGAATCTGCACTACACTTTTAGACACGGCTTTGTGCGGCAGGCATGCA
AGATATCTAACGTGGAACTCACCAACCTGGTTTCCTACATGGGTATTCTGCATGAGAATCGCCTAGGAC
AAAGCGTGCTGCACAGCACCCTGAAGGGGGAAGCCCGCCGTGATTACATCCGCGATTGTGTCTATCTGT
```

Figure 61 continued

```
ACCTGTGCCACACGTGGCAAACCGGCATGGGTGTATGGCAGCAATGTTTAGAAGAACAGAACTTGAAAG
AGCTTGACAAGCTCTTACAGAAATCTCTTAAGGTTCTGTGGACAGGGTTCGACGAGCGCACCGTCGCTT
CCGACCTGGCAGACCTCATCTTCCCAGAGCGTCTCAGGGTTACTTTGCGAAACGGATTGCCTGACTTTA
TGAGCCAGAGCATGCTTAACAATTTTCGCTCTTTCATCCTGGAACGCTCCGGTATCCTGCCCGCCACCT
GCTGCGCACTGCCCTCCGACTTTGTGCCTCTCACCTACCGCGAGTGCCCCCGCCGCTATGGAGTCACT
GCTACCTGTTCCGTCTGGCCAACTATCTCTCCTACCACTCGGATGTGATCGAGGATGTGAGCGGAGACG
GCTTGCTGGAGTGTCACTGCCGCTGCAATCTGTGCACGCCCCACCGGTCCCTAGCTTGCAACCCCCAGT
TGATGAGCGAAACCCAGATAATAGGCACCTTTGAATTGCAAGGCCCCAGCAGCCAAGGCGATGGGTCTT
CTCCTGGGCAAAGTTTAAAACTGACCCCGGGACTGTGGACCTCCGCCTACTTGCGCAAGTTTGCTCCGG
AAGATTACCACCCCTATGAAATCAAGTTCTATGAGGACCAATCACAGCCTCCAAAGGCCGAACTTTCGG
CCTGCGTCATCACCCAGGGGGCAATTCTGGCCCAATTGCAAGCCATCCAAAAATCCCGCCAAGAATTTC
TACTGAAAAAGGGTAAGGGGGTCTACCTTGACCCCCAGACCGGCGAGGAACTCAACACAAGGTTCCCTC
AGGATGTCCCAACGACGAGAAAACAAGAAGTTGAAGGTGCAGCCGCCGCCCCCAGAAGATATGGAGGAA
GATTGGGACAGTCAGGCAGAGGAGGCGGAGGAGGACAGTCTGGAGGACAGTCTGGAGGAAGACAGTTTG
GAGGAGGAAAACGAGGAGGCAGAGGAGGTGGAAGAAGTAACCGCCGACAAACAGTTATCCTCGGCTGCG
GAGACAAGCAACAGCGCTACCATCTCCGCTCCGAGTCGAGGAACCCGGCGGCGTCCCAGCAGTAGATGG
GACGAGACCGGACGCTTCCCGAACCCAACCAGCGCTTCCAAGACCGGTAAGAAGGATCGGCAGGGATAC
AAGTCCTGGCGGGGGCATAAGAATGCCATCATCTCCTGCTTGCATGAGTGCGGGGGCAACATATCCTTC
ACGCGGCGCTACTTGCTATTCCACCATGGGGTGAACTTTCGCGCAATGTTTTGCATTACTACCGTCAC
CTCCACAGCCCCTACTATAGCCAGCAAATCCCGGCAGTCTCGACAGATAAAGACAGCGGCGGCGACCTC
CAACAGAAAACCAGCAGCGGCAGTTAGAAAATACACAACAAGTGCAGCAACAGGAGGATTAAAGATTAC
AGCCAACGAGCCAGCGCAAACCCGAGAGTTAAGAAATCGGATCTTTCCAACCCTGTATGCCATCTTCCA
GCAGAGTCGGGGTCAAGAGCAGGAACTGAAAATAAAAAACCGATCTCTGCGTTCGCTCACCAGAAGTTG
TTTGTATCACAAGAGCGAAGATCAACTTCAGCGCACTCTCGAGGACGCCGAGGCTCTCTTCAACAAGTA
CTGCGCGCTGACTCTTAAAGAGTAGGCAGCGACCGCGCTTATTCAAAAAGGCGGGAATTACATCATCC
TCGACATGAGTAAAGAAATTCCCACGCCTTACATGTGGAGTTATCAACCCCAAATGGGATTGGCGGCAG
GCGCCTCCCAGGACTACTCCACCCGCATGAATTGGCTCAGCGCCGGGCCTTCTATGATTTCTCGAGTTA
ATGATATACGCGCCTACCGAAACCAAATACTTTTGGAACAGTCAGCTCTTACCACCACGCCCCGCCAAC
ACCTTAATCCCAGAAATTGGCCCGCCGCCCTAGTGTACCAGGAAAGTCCCGCTCCCACCACTGTATTAC
TTCCTCGAGACGCCCAGGCCGAAGTCCAAATGACTAATGCAGGTGCGCAGTTAGCTGGCGGCTCCACCC
TATGTCGTCACAGGCCTCGGCATAATATAAAACGCCTGATGATCAGAGGCCGAGGTATCCAGCTCAACG
ACGAGTCGGTGAGCTCTCCGCTTGGTCTACGACCAGACGGAATCTTTCAGATTGCCGGCTGCGGGAGAT
CTTCCTTCACCCCTCGTCAGGCTGTTCTGACTTTGGAAAGTTCGTCTTCGCAACCCCGCTCGGGCGGAA
TCGGGACCGTTCAATTTGTGGAGGAGTTTACTCCCTCTGTCTACTTCAACCCCTTCTCCGGATCTCCTG
GGCATTACCCGGACGAGTTCATACCGAACTTCGACGCGATTAGCGAGTCAGTGGACGGCTACGATTGAT
GTCTGGTGACGCGGCTGAGCTATCTCGGCTGCGACATCTAGACCACTGCCGCCGCTTTCGCTGCTTTGC
CCGGGAACTCATTGAGTTCATCTACTTCGAACTCCCCAAGGATCACCCTCAAGGTCCGGCCCACGGAGT
GCGGATTTCTATCGAAGGCAAAATAGACTCTCGCCTGCAACGAATTTTCTCCCAGCGGCCCGTGCTGAT
CGAGCGAGACCAGGGAAACACCACGGTTTCCATCTACTGCATTTGTAATCACCCCGGATTGCATGAAAG
CCTTTGCTGTCTTATGTGTACTGAGTTTAATAAAAACTGAATTAAGACTCTCCTACGGACTGCCGCTTC
TTCAACCCGGATTTTACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTTCCCTACTAATACTA
CTTTCAAAACCGGAGGTGAGCTCCAAGGTCTTCCTACAGAAAACCCTTGGGTGGAAGCGGGCCTTGTAG
TGCTAGGAATTCTTGCGGGTGGGCTTGTGATTATTCTTTGCTACCTATACACACCTTGCTTCACTTTCT
TAGTGGTGTTGTGGTATTGGTTTAAAAAATGGGGCCCATACTAGTCTTGCTTGTTTTACTTTCGCTTTT
GGAACCGGGTTCTGCCAATTACGATCCATGTCTAGACTTCGACCCAGAAAACTGCACACTTACTTTTGC
ACCCGACACAAGCCGCATCTGTGGAGTTCATCGCCTCTCTTACGAACTTGGCCCCAACGACAAAAATT
TACCTGCATGGTGGGAATCAACCCCATAGTTATCACCCAGCAAAGTGGAGATACTAAGGGTTGCATTCA
CTGCTCCTGCGATTCCATCGAGTGCACCTACACCCTGCTGAAGACCCTATGCGGCCTAAGAGACCTGCT
ACCAATGAATTAAAAAATGATTAATAAAAAATCACTTACTTGAAATCAGCAATAAGGTCTCTGTTGAAA
TTTTCTCCCAGCAGCACCTCACTTCCCTCTTCCCAACTCTGGTATTCTAAACCCCGTTCAGCGGCATAC
TTTCTCCATACTTTAAAGGGGATGTCAAATTTTAGCTCCTCTCCTGTACCCACAATCTTCATGTCTTTC
```

Figure 61 continued

```
TTCCCAGATGACCAAGAGAGTCCGGCTCAGTGACTCCTTCAACCCTGTCTACCCCTATGAAGATGAAAG
CACCTCCCAACACCCCTTTATAAACCCAGGGTTTATTTCCCCAAATGGCTTCACACAAAGCCCAAACGG
AGTTCTTACTTTAAAATGTTTAACCCCACTAACAACCACAGGCGGATCTCTACAGCTAAAAGTGGGAGG
GGGACTTACAGTGGATGACACCAACGGTTTTTGAAAGAAAACATAAGTGCCACCACACCACTCGTTAA
GACTGGTCACTCTATAGGTTTACCACTAGGAGCCGGATTGGGAACGAATGAAAATAAACTTTGTATCAA
ATTAGGACAAGGACTTACATTCAATTCAAACAACATTTGCATTGATGACAATATTAACACCTTATGGAC
AGGAGTCAACCCCACCGAAGCCAACTGTCAAATCATGAACTCCAGTGAATCTAATGATTGCAAATTAAT
TCTAACACTAGTTAAAACTGGAGCACTAGTCACTGCATTTGTTTATGTTATAGGAGTATCTAACAATTT
TAATATGCTAACTACACACAGAAATATAAATTTTACTGCAGAGCTGTTTTCGATTCTACTGGTAATTT
ACTAACTAGACTCTCATCCCTCAAAACTCCACTTAATCATAAATCAGGACAAAACATGGCTACTGGTGC
CATTACTAATGCTAAAGGTTTCATGCCCAGCACGACTGCCTATCCTTTCAATGATAATTCTAGAGAAAA
AGAAAACTACATTTACGGAACTTGTTACTACACAGCTAGTGATCGCACTGCTTTTCCCATTGACATATC
TGTCATGCTTAACCGAAGAGCAATAAATGACGAGACATCATATTGTATTCGTATAACTTGGTCCTGGAA
CACAGGAGATGCCCCAGAGGTGCAAACCTCTGCTACAACCCTAGTCACCTCCCATTTACCTTTTACTA
CATCAGAGAAGACGACTGACAAATAAAGTTTAACTTGTTTATTTGAAAATCAATTCACAAAATCCGAGT
AGTTATTTTGCCTCCCCCTTCCCATTTAACAGAATACACCAATCTCTCCCACGCACAGCTTTAAACAT
TTGGATACCATTAGATATAGACATGGTTTTAGATTCCACATTCCAAACAGTTTCAGAGCGAGCCAATCT
GGGGTCAGTGATAGATAAAAATCCATCGGGATAGTCTTTTAAAGCGCTTTCACAGTCCAACTGCTGCGG
ATGCGACTCCGGAGTCTGGATCACGGTCATCTGGAAGAAGAACGATGGGAATCATAATCCGAAAACGGT
ATCGGACGATTGTGTCTCATCAAACCCACAAGCAGCCGCTGTCTGCGTCGCTCCGTGCGACTGCTGTTT
ATGGGATCAGGGTCCACAGTGTCCTGAAGCATGATTTAATAGCCCTTAACATCAACTTTCTGGTGCGA
TGCGCGCAGCAACGCATTCTGATTTCACTCAAATCTTTGCAGTAGGTACAACACATTATTACAATATTG
TTTAATAAACCATAATTAAAAGCGCTCCAGCCAAAACTCATATCTGATATAATCGCCCTGCATGACCA
TCATACCAAAGTTTAATATAAATTAAATGACGTTCCCTCAAAAACACACTACCCACATACATGATCTCT
TTTGGCATGTGCATATTAACAATCTGTCTGTACCATGGACAACGTTGGTTAATCATGCAACCCAATATA
ACCTTCCGGAACCACACTGCCAACACCGCTCCCCAGCCATGCATTGAAGTGAACCCTGCTGATTACAA
TGACAATGAAGAACCCAATTCTCTCGACCGTGAATCACTTGAGAATGAAAAATATCTATAGTGGCACAA
CATAGACATAAATGCATGCATCTTCTCATAATTTTTAACTCCTCAGGATTTAGAAACATATCCCAGGGA
ATAGGAAGCTCTTGCAGAACAGTAAAGCTGGCAGAACAAGGAAGACCACGAACACAACTTACACTATGC
ATAGTCATAGTATCACAATCTGGCAACAGCGGGTGGTCTTCAGTCATAGAAGCTCGGGTTTCATTTTCC
TCACAACGTGGTAACTGGGCTCTGGTGTAAGGGTGATGTCTGGCGCATGATGTCGAGCGTGCGCGCAAC
CTTGTCATAATGGAGTTGCTTCCTGACATTCTCGTATTTGTATAGCAAAACGCGGCCCTGGCAGAACA
CACTCTTCTTCGCCTTCTATCCTGCCGCTTAGCGTGTTCCGTGTGATAGTTCAAGTACAACCACACTCT
TAAGTTGGTCAAAAGAATGCTGGCTTCAGTTGTAATCAAAACTCCATCGCATCTAATCGTTCTGAGGAA
ATCATCCAAGCAATGCAACTGGATTGTGTTTCAAGCAGGAGAGGAGAGGGAAGAGACGGAAGAACCATG
TTAATTTTTATTCCAAACGATCTCGCAGTACTTCAAATTGTAGATCGCGCAGATGGCATCTCTCGCCCC
CACTGTGTTGGTGAAAAAGCACAGCTAGATCAAAAGAAATGCGATTTTCAAGGTGCTCAACGGTGGCTT
CCAGCAAAGCCTCCACGCGCACATCCAAGAACAAAAGAATACCAAAAGAAGGAGCATTTTCTAACTCCT
CAATCATCATATTACATTCCTGCACCATTCCCAGATAATTTTCAGCTTTCCAGCCTTGAATTATTCGTG
TCAGTTCTTGTGGTAAATCCAATCCACACATTACAAACAGGTCCCGGAGGGCGCCCTCCACCACCATTC
TTAAACACACCCTCATAATGACAAAATATCTTGCTCCTGTGTCACCTGTAGCGAATTGAGAATGGCAAC
ATCAATTGACATGCCCTTGGCTCTAAGTTCTTCTTTAAGTTCTAGTTGTAAAAACTCTCTCATATTATC
ACCAAACTGCTTAGCCAGAAGCCCCCGGGAACAAGAGCAGGGACGCTACAGTGCAGTACAAGCGCAG
ACCTCCCCAATTGGCTCCAGCAAAAACAAGATTGGAATAAGCATATTGGGAACCGCAGTAATATCATC
GAAGTTGCTGGAAATATAATCAGGCAGAGTTTCTTGTAAAAATTGAATAAAAGAAAATTTGCCAAAAA
AACATTCAAAACCTCTGGGATGCAAATGCAATAGGTTACCGCGCTGCGCTCCAACATTGTTAGTTTTGA
ATTAGTCTGCAAAAATAAAAAAAAAAACAAGCGTCATATCATAGTAGCCTGACGAACAGATGGATAAAT
CAGTCTTTCCATCACAAGACAAGCCACAGGGTCTCCAGCTCGACCCTCGTAAAACCTGTCATCATGATT
AAACAACAGCACCGAAAGTTCCTCGCGGTGACCAGCATGAATAATTCTTGATGAAGCATACAATCCAGA
CATGTTAGCATCAGTTAACGAGAAAAACAGCCAACATAGCCTTTGGGTATAATTATGCTTAATCGTAA
GTATAGCAAAGCCACCCCTCGCGGATACAAAGTAAAGGCACAGGAGAATAAAAAATATAATTATTTCT
CTGCTGCTGTTCAGGCAACGTCGCCCCCGGTCCCTCTAAATACACATACAAAGCCTCATCAGCCATGGC
```

Figure 61 continued

TTACCAGACAAAGTACAGCGGGCACACAAAGCACAAGCTCTAAAGTGACTCTCCAACCTCTCCACAATA
TATATATACACAAGCCCTAAACTGACGTAATGGGAGTAAAGTGTAAAAAATCCCGCCAAACCCAACACA
CACCCCGAAACTGCGTCACCAGGGAAAAGTACAGTTTCACTTCCGCAATCCCAACAGGCGTAACTTCCT
CTTTCTCACGGTACGTGATATCCCACTAACTTGCAACGTCATTTTCCCACGGTCGCACCGCCCCTTTTA
GCCGTTAACCCCACAGCCAATCACCACACGATCCACACTTTTAAAATCACCTCATTTACATATTGGCA
CCATTCCATCTATAAGGTATATTATATAGATAGA

Figure 62
SEQ ID NO: 87 DNA CORRESPONDING TO E2B REGION OF THE ENAD GENOME (BP 10355-5068)

CTATGGCATCTCGATCCAGCAGACCTCCTCGTTTCGCGGGTTTGGACGGCTCCTGGAATAGGGTATGAG
ACGATGGGCGTCCAGCGCTGCCAGGGTTCGGTCCTTCCAGGGTCTCAGTGTTCGAGTCAGGGTTGTTTC
CGTCACAGTGAAGGGGTGTGCGCCTGCTTGGGCGCTTGCCAGGGTGCGCTTCAGACTCATCCTGCTGGT
CGAAAACTTCTGTCGCTTGGCGCCCTGTATGTCGGCCAAGTAGCAGTTTACCATGAGTTCGTAGTTGAG
CGCCTCGGCTGCGTGGCCTTTGGCGCGGAGCTTACCTTTGGAAGTTTTCTTGCATACCGGGCAGTATAG
GCATTTCAGCGCATACAACTTGGGCGCAAGGAAAACGGATTCTGGGGAGTATGCATCTGCGCCGCAGGA
GGCGCAAACAGTTTCACATTCCACCAGCCAGGTTAAATCCGGTTCATTGGGGTCAAAAACAAGTTTTCC
GCCATATTTTTGATGCGTTTCTTACCTTTGGTCTCCATGAGTTCGTGTCCTCGTTGAGTGACAAACAG
GCTGTCCGTGTCCCCGTAGACTGATTTTACAGGCCTCTTCTCCAGTGGAGTGCCTCGGTCTTCTTCGTA
CAGGAACTCTGACCACTCTGATACAAAGGCGCGCGTCCAGGCCAGCACAAAGGAGGCTATGTGGGAGGG
GTAGCGATCGTTGTCAACCAGGGGGTCCACCTTTTCCAAAGTATGCAAACACATGTCACCCTCTTCAAC
ATCCAGGAATGTGATTGGCTTGTAGGTGTATTTCACGTGACCTGGGGTCCCCGCTGGGGGGTATAAAA
GGGGGCGGTTCTTTGCTCTTCCTCACTGTCTTCCGGATCGCTGTCCAGGAACGTCAGCTGTTGGGGTAG
GTATTCCCTCTCGAAGGCGGGCATGACCTCTGCACTCAGGTTGTCAGTTTCTAAGAACGAGGAGGATTT
GATATTGACAGTGCCGGTTGAGATGCCTTTCATGAGGTTTTCGTCCATCTGGTCAGAAAACACAATTTT
TTTATTGTCAAGTTTGGTGGCAAATGATCCATACAGGGCGTTGGATAAAAGTTTGGCAATGGATCGCAT
GGTTTGGTTCTTTTCCTTGTCCGCGCGCTCTTTGGCGGCGATGTTGAGTTGGACATACTCGCGTGCCAG
GCACTTCCATTCGGGGAAGATAGTTGTTAATTCATCGGCACGATTCTCACTTGCCACCCTCGATTATG
CAAGGTAATTAAATCCACACTGGTGGCCACCTCGCCTCGAAGGGGTTCATTGGTCCAACAGAGCCTACC
TCCTTTCCTAGAACAGAAAGGGGGAAGTGGGTCTAGCATAAGTTCATCGGGAGGGTCTGCATCCATGGT
AAAGATTCCCGGAAGTAAATCCTTATCAAAATAGCTGATGGGAGTGGGGTCATCTAAGGCCATTTGCCA
TTCTCGAGCTGCCAGTGCGCGCTCATATGGGTTAAGGGGACTGCCCCATGGCATGGGATGGGTGAGTGC
AGAGGCATACATGCCACAGATGTCATAGACGTAGATGGGATCCTCAAAGATGCCTATGTAGGTTGGATA
GCATCGCCCCCTCTGATACTTGCTCGCACATAGTCATATAGTTCATGTGATGGCGCTAGCAGCCCCGG
ACCCAAGTTGGTGCGATTGGGTTTTTCTGTTCTGTAGACGATCTGGCGAAAGATGGCGTGAGAATTGGA
AGAGATGGTGGGTCTTTGAAAAATGTTGAAATGGGCATGAGGTAGACCTACAGAGTCTCTGACAAAGTG
GGCATAAGATTCTTGAAGCTTGGTTACCAGTTCGGCGGTGACAAGTACGTCTAGGGCGCAGTAGTCAAG
TGTTTCTTGAATGATGTCATAACCTGGTTGGTTTTCTTTTCCCACAGTTCGCGGTTGAGAAGGTATTC
TTCGCGATCCTTCCAGTACTCTTCTAGCGGAAACCCGTCTTTGTCTGCACGGTAAGATCCTAGCATGTA
GAACTGATTAACTGCCTTGTAAGGGCAGCAGCCCTTCTCTACGGGTAGAGAGTATGCTTGAGCAGCTTT
TCGTAGCGAAGCGTGAGTAAGGGCAAAGGTGTCTCTGACCATGACTTTGAGGAATTGGTATTTGAAGTC
GATGTCGTCACAGGCTCCCTGTTCCCAGAGTTGGAAGTCTACCCGTTCTTGTAGGCGGGGTTGGGCAA
AGCGAAAGTAACATCATTGAAGAGAATCTTGCCGGCCCTGGGCATGAAATTGCGAGTGATGCGAAAAGG
CTGTGGTACTTCCGCTCGGTTATTGATAACCTGGGCAGCTAGGACGATCTCGTCGAAACCGTTGATGTT
GTGTCCTACGATGTATAATTCTATGAAACGCGGCGTGCCTCTGACGTGAGGTAGCTTACTGAGCTCATC
AAAGGTTAGGTCTGTGGGGTCAGATAAGGCGTAGTGTTCGAGAGCCCATTCGTGCAGGTGAGGATTCGC
TTTAAGGAAGGAGGACCAGAGGTCCACTGCCAGTGCTGTTTGTAACTGGTCCCGGTACTGACGAAAATG
CCGTCCGACTGCCATTTTTTCTGGGGTGACGCAATAGAAGGTTTGGGGGTCCTGCCGCCAGCGATCCCA
CTTGAGTTTTATGGCGAGGTCATAGGCGATGTTGACGAGCCGCTGGTCTCCAGAGAGTTTCATGACCAG
CATGAAGGGGATTAGCTGCTTGCCAAAGGACCCCATCCAGGTGTAGGTTTCCACATCGTAGGTGAGAAA

Figure 62 continued

```
GAGCCTTTCTGTGCGAGGATGAGAGCCAATCGGGAAGAACTGGATCTCCTGCCACCAGTTGGAGGAATG
GCTGTTGATGTGATGGAAGTAGAACTCCCTGCGACGCGCCGAGCATTCATGCTTGTGCTTGTACAGACG
GCCGCAGTAGTCGCAGCGTTGCACGGGTTGTATCTCGTGAATGAGTTGTACCTGGCTTCCCTTGACGAG
AAATTTCAGTGGGAAGCCGAGGCCTGGCGATTGTATCTCGTGCTTTACTATGTTGTCTGCATCGGCCTG
TTCATCTTCTGTCTCGATGGTGGTCATGCTGACGAGCCCTCGCGGGAGGCAAGTCCAGACCTCGGCGCG
GCAGGGGCGGAGCTCGAGGACGAGAGCGCGCAGGCTGGAGCTGTCCAGGGTCCTGAGACGCTGCGGACT
CAGGTTAGTAGGCAGTGTCAGGAGATTAACTTGCATGATCTTTTGGAGGGCGTGCGGGAGGTTCAGATA
GTACTTGATCTCAACGGGTCCGTTGGTGGAGATGTCGATGGCTTGCAGGGTTCCGTGTCCTTGGGCGC
TACCACCGTGCCCTTGTTTTTCATTTGGACGGCGGTGGCTCTGTTGCTTCTTGCATGTTTAGAAGCGG
TGTCGAGGGCGCGCACCGGGCGGCAGGGGCGGCTCGGGACCCGGCGGCATGGCTGGCAGTGGTACGTCG
GCGCCGCGCGGGTAGGTTCTGGTACTGCGCCCTGAGAAGACTCGCATGCGCGACGACGCGGCGGTTG
ACATCCTGGATCTGACGCCTCTGGGTGAAAGCTACCGGCCCCGTGAGCTTGAACCTGAAAGAGAGTTCA
ACAGAATCAATCTCGGTATCGTTGACGGCGGCTTGCCTAAGGATTTCTTGCACGTCACCAGAGTTGTCC
TGGTAGGCGATCTCCGCCATGAACTGCTCGATCTCTTCCTCTTGAAGATCTCCGCGGCCCGCTCTCTCG
ACGGTGGCCGCGAGGTCGTTGGAGATGCGCCCAATGAGTTGAGAGAATGCATTCATGCCCGCCTCGTTC
CAGACGCGGCTGTAGACCACGGCCCCCACGGGATCTCTCGCGCGCATGACCACCTGGGCGAGGTTGAGC
TCCACGTGGCGGGTGAAGACCGCATAGTTGCATAGGCGCTGGAAAAGGTAGTTGAGTGTGGTGGCGATG
TGCTCGGTGACGAAGAAATACATGATCCATCGTCTCAGCGGCATCTCGCTGACATCGCCCAGAGCTTCC
AAGCGCTCCATGGCCTCGTAGAAGTCCACGGCAAAATTAAAAAACTGGGAGTTTCGCGCGGACACGGTC
AACTCCTCTTCCAGAAGACGGATAAGTTCGGCGATGGTGGTGCGCACCTCGCGCTCGAAAGCCCCTGGG
ATTTCTTCCTCAATCTCTTCTTCTTCCACTAACATCTCTTCCTCTTCAGGTGGGGCTGCAGGAGGAGGG
GGAACGCGGCGACGCCGGCGGCGCACGGGCAGACGGTCGATGAATCTTTCAATGACCTCTCCGCGGCGG
CGGCGCATGGTTTCAGTGACGGCGCGGCCGTTCTCGCGCGGTCGCAGAGTAAAAACACCGCCGCGCATC
TCCTTAAAGTGGTGACTGGGAGGTTCTCCGTTTGGGAGGGAGAGGGCGCTGATTATACATTTTATTAAT
TGGCCCGTAGGGACTGCACGCAGAGATCTGATCGTGTCAAGATCCACGGGATCTGAAAACCTTTCGACG
AAAGCGTCTAACCAGTCACAGTCACAAGGTAGGCTGAGTACGGCTTCTTGTGGGCGGGGGTGGTTATGT
GTTCGGTCTGGGTCTTCTGTTTCTTCTTCATCTCGGGAAGGTGAGACGATGCTGCTGGTGATGAAATTA
AAGTAGGCAGTTCTAAGACGGCGGATGGTGGCGAGGAGCACCAGGTCTTTGGGTCCGGCTTGCTGGATA
CGCAGGCGATTGGCCATTCCCCAAGCATTATCCTGACATCTAGCAAGATCTTTGTAGTAGTCTTGCATG
AGCCGTTCTACGGGCACTTCTTCCTCACCCGTTCTGCCATGCATACGTGTGAGTCCAAATCCGCGCATT
GGTTGTACCAGTGCCAAGTCAGCTACGACTCTTTCGGCGAGGATGGCTTGCTGTACTTGGGTAAGGGTG
GCTTGAAAGTCATCAAAATCCACAAAGCGGTGGTAAGCTCCTGTATTAATGGTGTAAGCACAGTTGGCC
ATGACTGACCAGTTAACTGTCTGGTGACCAGGGCGCACGAGCTCGGTGTATTTAAGGCGCGAATAGGCG
CGGGTGTCAAAGATGTAATCGTTGCAGGTGCGCACCAGATACTGGTACCCTATAAGAAATGCGGCGGT
GGTTGGCGGTAGAGAGGCCATCGTTCTGTAGCTGGAGCGCCAGGGGCGAGGTCTTCCAACATAAGGCGG
TGATAGCCGTAGATGTACCTGGACATCCAGGTGATTCCTGCGGCGGTAGTAGAAGCCCGAGGAAACTCG
CGTACGCGGTTCCAAATGTTGCGTAGCGGCATGAAGTAGTTCAT
```

SEQ ID NO: 88 A NON-CODING SEQUENCE SUITABLE FOR INCLUSION INTO BX
```
AAAATGATTAATAAAAAATCACTTACTTGAAATCAGCAATAAGGTCTCTGTTGAAATTTTCTCCCAGCA
GCACCTCACTTCCCTCTTCCCAACTCTGGTATTCTAAACCCCGTTCAGCGGCATACTTTCTCCATACTT
TAAAGGGGATGTCAAATTTTAGCTCCTCTCCTGTACCCACAATCTTCATGTCTTTCTTCCCAG
```
SEQ ID NO: 89 A NON-CODING SEQUENCE SUITABLE FOR INCLUSION INTO BY
```
CAAATAAAGTTTAACTTGTTTATTTGAAAATCAA
```
SEQ ID NO. 90 SPLICE ACCEPTOR SEQUENCE
```
TTTCTCTCTT CAGG
```
SEQ ID NO. 91 SPLICE ACCEPTOR SEQUENCE
```
TGCTAATCTT CCTTTCTCTC TTCAGG
```

Figure 63

SEQ ID NO: 93 Internal Ribosome Entry Sequence (IRES)
CGTTACTGGCCGAAGCCGCTTGGAATAAGGCCGGTGTGCGTTTGTCTATATGTTATTTTCCACCATATT
GCCGTCTTTTGGCAATGTGAGGGCCCGGAAACCTGGCCCTGTCTTCTTGACGAGCATTCCTAGGGGTCT
TTCCCCTCTCGCCAAAGGAATGCAAGGTCTGTTGAATGTCGTGAAGGAAGCAGTTCCTCTGGAAGCTTC
TTGAAGACAAACAACGTCTGTAGCGACCCTTTGCAGGCAGCGGAACCCCCCACCTGGCGACAGGTGCCT
CTGCGGCCAAAAGCCACGTGTATAAGATACACCTGCAAAGGCGGCACAACCCCAGTGCCACGTTGTGAG
TTGGATAGTTGTGGAAAGAGTCAAATGGCTCCCCTCAAGCGTATTCAACAAGGGGCTGAAGGATGCCCA
GAAGGTACCCCATTGTATGGGATCTGATCTGGGGCCTCGGTGCACATGCTTTTCATGTGTTAGTCGAG
GTTAAAAAACGTCTAGGCCCCCCGAACCACGGGGACGTGGTTTTCCTTTGAAAAACACGATGATAATA

SEQ ID NO: 94 High efficiency self-cleavable P2A peptide sequence
GSGATNFSLLKQAGDVEENPGP

SEQ ID NO: 95 High efficiency self-cleavable F2A peptide sequence
GSGEGRGSLLTCGDVEENPGP

SEQ ID NO: 96 High efficiency self-cleavable E2A peptide sequence
GSGQCTNYALLKLAGDVESNPGP

SEQ ID NO: 97 High efficiency self-cleavable T2A peptide sequence
GSGVKQTLNFDLLKLAGDVESNPGP

SEQ ID NO: 98 Human CD80 amino acid sequence
MGHTRRQGTSPSKCPYLNFFQLLVLAGLSHFCSGVIHVTKEVKEVATLSCGHNVSVEELAQTRIYWQKE
KKMVLTMMSGDMNIWPEYKNRTIFDITNNLSIVILALRPSDEGTYECVVLKYEKDAFKREHLAEVTLSV
KADFPTPSISDFEIPTSNIRRIICSTSGGFPEPHLSWLENGEELNAINTTVSQDPETELYAVSSKLDFN
MTTNHSFMCLIKYGHLRVNQTFNWNTTKQEHFPDNLLPSWAITLISVNGIFVICCLTYCFAPRCRERRR
NERLRRESVRPV

SEQ ID NO. 99 poly adenylation sequence (SV40 late polyA sequence)
CAGACATGATAAGATACATTGATGAGTTTGGACAAACCACAACTAGAATGCAGTGAAAAAAATGCTTTA
TTTGTGAAATTTGTGATGCTATTGCTTTATTTGTAACCATTATAAGCTGCAATAAACAAGTTAACAACA
ACAATTGCATTCATTTTATGTTTCAGGTTCAGGGGGAGGTGTGGGAGGTTTTTT

Figure 64

SEQ ID NO. 100 NG-348 virus genome sequence comprising the EnAd genome with a transgene cassette that encodes a membrane-anchored chimeric form of the single chain Fv anti-human CD3e and the T lymphocyte activation antigen, CD80 inserted in the region Bγ. The transgene cassette contains a 5' SSA, membrane-anchored anti-CD3ε cDNA sequence, P2A peptide, human CD80 cDNA sequence and a 3' poly(A) sequence
TCTATCTATATAATATACCTTATAGATGGAATGGTGCCAATATGTAAATGAGGTGATTTTAAAAGTGT
GGATCGTGTGGTGATTGGCTGTGGGGTTAACGGCTAAAAGGGGCGGTGCGACCGTGGGAAAATGACGTT
TTGTGGGGGTGGAGTTTTTTGCAAGTTGTCGCGGGAAATGTGACGCATAAAAGGCTTTTTCTCACG
GAACTACTTAGTTTTCCCACGGTATTTAACAGGAAATGAGGTAGTTTTGACCGGATGCAAGTGAAAATT
GTTGATTTTCGCGCGAAAACTGAATGAGGAAGTGTTTTCTGAATAATGTGGTATTTATGGCAGGGTGG
AGTATTTGTTCAGGGCCAGGTAGACTTTGACCCATTACGTGGAGGTTTCGATTACCGTGTTTTTACCT
GAATTTCCGCGTACCGTGTCAAAGTCTTCTGTTTTACGTAGGTGTCAGCTGATCGCTAGGGTATTTAT
ACCTCAGGGTTTGTGTCAAGAGGCCACTCTTGAGTGCCAGCGAGAAGAGTTTTCTCCTCTGCGCCGGCA
GTTTAATAATAAAAAAATGAGAGATTTGCGATTTCTGCCTCAGGAAATAATCTCTGCTGAGACTGGAAA
TGAAATATTGGAGCTTGTGGTGCACGCCCTGATGGGAGACGATCCGGAGCCACCTGTGCAGCTTTTGA
GCCTCCTACGCTTCAGGAACTGTATGATTTAGAGGTAGAGGGATCGGAGGATTCTAATGAGGAAGCTGT
AAATGGCTTTTTTACCGATTCTATGCTTTTAGCTGCTAATGAAGGGTTAGAATTAGATCCGCCTTTGGA
CACTTTTGATACTCCAGGGGTAATTGTGGAAAGCGGTACAGGTGTAAGAAAATTACCTGATTTGAGTTC

Figure 64 continued

```
CGTGGACTGTGATTTGCACTGCTATGAAGACGGGTTTCCTCCGAGTGATGAGGAGGACCATGAAAAGGA
GCAGTCCATGCAGACTGCAGCGGGTGAGGGAGTGAAGGCTGCCAATGTTGGTTTTCAGTTGGATTGCCC
GGAGCTTCCTGGACATGGCTGTAAGTCTTGTGAATTTCACAGGAAAAATACTGGAGTAAAGGAACTGTT
ATGTTCGCTTTGTTATATGAGAACGCACTGCCACTTTATTTACAGTAAGTGTGTTTAAGTTAAAATTTA
AAGGAATATGCTGTTTTTCACATGTATATTGAGTGTGAGTTTTGTGCTTCTTATTATAGGTCCTGTGTC
TGATGCTGATGAATCACCATCTCCTGATTCTACTACCTCACCTCCTGAGATTCAAGCACCTGTTCCTGT
GGACGTGCGCAAGCCCATTCCTGTGAAGCTTAAGCCTGGGAAACGTCCAGCAGTGGAAAAACTTGAGGA
CTTGTTACAGGGTGGGGACGGACCTTTGGACTTGAGTACACGGAAACGTCCAAGACAATAAGTGTTCCA
TATCCGTGTTTACTTAAGGTGACGTCAATATTTGTGTGACAGTGCAATGTAATAAAAATATGTTAACTG
TTCACTGGTTTTTATTGCTTTTGGGCGGGGACTCAGGTATATAAGTAGAAGCAGACCTGTGTGGTTAG
CTCATAGGAGCTGGCTTTCATCCATGGAGGTTTGGGCCATTTTGGAAGACCTTAGGAAGACTAGGCAAC
TGTTAGAGAACGCTTCGGACGGAGTCTCCGGTTTTGGAGATTCTGGTTCGCTAGTGAATTAGCTAGGG
TAGTTTTTAGGATAAAACAGGACTATAAACAAGAATTTGAAAAGTTGTTGGTAGATTGCCCAGGACTTT
TTGAAGCTCTTAATTTGGGCCATCAGGTTCACTTTAAAGAAAAGTTTTATCAGTTTTAGACTTTTCAA
CCCCAGGTAGAACTGCTGCTGCTGTGGCTTTTCTTACTTTTATATTAGATAAATGGATCCCGCAGACTC
ATTTCAGCAGGGGATACGTTTTGGATTTCATAGCCACAGCATTGTGGAGAACATGGAAGGTTCGCAAGA
TGAGGACAATCTTAGGTTACTGGCCAGTGCAGCCTTTGGGTGTAGCGGGAATCCTGAGGCATCCACCGG
TCATGCCAGCGGTTCTGGAGGAGGAACAGCAAGAGGACAACCCGAGAGCCGGCCTGGACCCTCCAGTGG
AGGAGGCGGAGTAGCTGACTTGTCTCCTGAACTGCAACGGGTGCTTACTGGATCTACGTCCACTGGACG
GGATAGGGGCGTTAAGAGGGAGAGGGCATCTAGTGGTACTGATGCTAGATCTGAGTTGGCTTTAAGTTT
AATGAGTCGCAGACGTCCTGAAACCATTTGGTGGCATGAGGTTCAGAAAGAGGGAAGGGATGAAGTTTC
TGTATTGCAGGAGAAATATTCACTGGAACAGGTGAAAACATGTTGGTTGGAGCCTGAGGATGATTGGA
GGTGGCCATTAAAAATTATGCCAAGATAGCTTTGAGGCCTGATAAACAGTATAAGATTACTAGACGGAT
TAATATCCGGAATGCTTGTTACATATCTGGAAATGGGCTGAGGTGGTAATAGATACTCAAGACAAGGC
AGTTATTAGATGCTGCATGATGGATATGTGGCCTGGGGTAGTCGGTATGGAAGCAGTAACTTTTGTAAA
TGTTAAGTTTAGGGGAGATGGTTATAATGGAATAGTGTTTATGGCCAATACCAAACTTATATTGCATGG
TTGTAGCTTTTTTGGTTTCAACAATACCTGTGTAGATGCCTGGGGACAGGTTAGTGTACGGGGATGTAG
TTTCTATGCGTGTTGGATTGCCACAGCTGGCAGAACCAAGAGTCAATTGTCTCTGAAGAAATGCATATT
TCAAAGATGTAACCTGGGCATTCTGAATGAAGGCGAAGCAAGGGTCCGCCACTGCGCTTCTACAGATAC
TGGATGTTTTATTTTGATTAAGGGAAATGCCAGCGTAAAGCATAACATGATTTGCGGTGCTTCCGATGA
GAGGCCTTATCAAATGCTCACTTGTGCTGGTGGCATTGTAATATGCTGGCTACTGTGCATATTGTTTC
CCATCAACGCAAAAAATGGCCTGTTTTGATCACAATGTGATGACGAAGTGTACCATGCATGCAGGTGG
GCGTAGAGGAATGTTTATGCCTTACCAGTGTAACATGAATCATGTGAAAGTGTTGTTGGAACCAGATGC
CTTTTCCAGAATGAGCCTAACAGGAATTTTTGACATGAACATGCAAATCTGGAAGATCCTGAGGTATGA
TGATACGAGATCGAGGGTACGCGCATGCGAATGCGGAGGCAAGCATGCCAGGTTCCAGCCGGTGTGTGT
AGATGTGACTGAAGATCTCAGACCGGATCATTTGGTTATTGCCCGCACTGGAGCAGAGTTCGGATCCAG
TGGAGAAGAAACTGACTAAGGTGAGTATTGGGAAAACTTTGGGGTGGGATTTTCAGATGGACAGATTGA
GTAAAAATTTGTTTTTCTGTCTTGCAGCTGTCATGAGTGGAAACGCTTCTTTTAAGGGGGGAGTCTTC
AGCCCTTATCTGACAGGGCGTCTCCCATCCTGGGCAGGAGTTCGTCAGAATGTTATGGGATCTACTGTG
GATGGAAGACCCGTCCAACCCGCCAATTCTTCAACGCTGACCTATGCTACTTTAAGTTCTTCACCTTTG
GACGCAGCTGCAGCTGCCGCCGCCGCTTCTGTTGCCGCTAACACTGTGCTTGGAATGGGTTACTATGGA
AGCATCATGGCTAATTCCACTTCCTCTAATAACCCTTCTACCCTGACTCAGGACAAGTTACTTGTCCTT
TTGGCCCAGCTGGAGGCTTTGACCCAACGTCTGGGTGAACTTTCTCAGCAGGTGGTCGAGTTGCGAGTA
CAAACTGAGTCTGCTGTCGGCACGGCAAAGTCTAAATAAAAAAATCCCAGAATCAATGAATAAATAAAC
AAGCTTGTTGTTGATTTAAAATCAAGTGTTTTTATTTCATTTTTCGCGCACGGTATGCCCTAGACCACC
GATCTCTATCATTGAGAACTCGGTGGATTTTTCCAGGATCCTATAGAGGTGGGATTGAATGTTTAGAT
ACATGGGCATTAGGCCGTCTTTGGGGTGGAGATAGCTCCATTGAAGGGATTCATGCTCCGGGGTAGTGT
TGTAAATCACCCAGTCATAACAAGGTCGCAGTGCATGGTGTTGCACAATATCTTTTAGAAGTAGGCTGA
TTGCCACAGATAAGCCCTTGGTGTAGGTGTTTACAAACCGGTTGAGCTGGGATGGGTGCATTCGGGGTG
AAATTATGTGCATTTTGGATTGGATTTTAAGTTGGCAATATTGCCGCCAAGATCCCGTCTTGGGTTCA
TGTTATGAAGGACCACCAAGACGGTGTATCCGGTACATTTAGGAAATTTATCGTGCAGCTTGGATGGAA
AAGCGTGGAAAAATTTGGAGACACCCTTGTGTCCTCCAAGATTTTCCATGCACTCATCCATGATAATAG
```

Figure 64 continued

```
CAATGGGGCCGTGGGCAGCGGCGCGGGCAAACACGTTCCGTGGGTCTGACACATCATAGTTATGTTCCT
GAGTTAAATCATCATAAGCCATTTTAATGAATTTGGGGCGGAGAGTACCAGATTGGGGTATGAATGTTC
CTTCGGGCCCCGGAGCATAGTTCCCCTCACAGATTTGCATTTCCCAAGCTTTCAGTTCCGAGGGTGGAA
TCATGTCCACCTGGGGGGCTATGAAAAACACCGTTTCTGGGGCGGGGGTGATTAATTGTGATGATAGCA
AATTTCTGAGCAATTGAGATTTGCCACATCCGTGGGGCCATAAATGATTCCGATTACGGGTTGCAGGT
GGTAGTTTAGGGAACGGCAACTGCCGTCTTCTCGAAGCAAGGGGGCCACCTCGTTCATCATTTCCCTTA
CATGCATATTTTCCCGCACCAAATCCATTAGGAGGCGCTCCTCCTAGTGATAGAAGTTCTTGTAGTG
AGGAAAAGTTTTTCAGCGGTTTCAGACCGTCAGCCATGGGCATTTGGAGAGAGTTTGCTGCAAAAGTT
CTAGTCTGTTCCACAGTTCAGTGATGTGTTCTATGGCATCTCGATCCAGCAGACCTCCTCGTTTCGCGG
GTTTGGACGGCTCCTGGAATAGGGTATGAGACGATGGGCGTCCAGCGCTGCCAGGGTTCGGTCCTTCCA
GGGTCTCAGTGTTCGAGTCAGGGTTGTTTCCGTCACAGTGAAGGGGTGTGCGCCTGCTTGGGCGCTTGC
CAGGGTGCGCTTCAGACTCATCCTGCTGGTCGAAAACTTCTGTCGCTTGGCGCCCTGTATGTCGGCCAA
GTAGCAGTTTACCATGAGTTCGTAGTTGAGCGCCTCGGCTGCGTGGCCTTTGGCGCGGAGCTTACCTTT
GGAAGTTTTCTTGCATACCGGGCAGTATAGGCATTTCAGCGCATACAACTTGGGCGCAAGGAAAACGGA
TTCTGGGAGTATGCATCTGCGCCGCAGGAGGCGCAAACAGTTTCACATTCCACCAGCCAGGTTAAATC
CGGTTCATTGGGGTCAAAAACAAGTTTTCCGCCATATTTTTGATGCGTTTCTTACCTTTGGTCTCCAT
GAGTTCGTGTCCTCGTTGAGTGACAAACAGGCTGTCCGTGTCCCCGTAGACTGATTTTACAGGCCTCTT
CTCCAGTGGAGTGCCTCGGTCTTCTTCGTACAGGAACTCTGACCACTCTGATACAAAGGCGCGCGTCCA
GGCCAGCACAAAGGAGGCTATGTGGGAGGGGTAGCGATCGTTGTCAACCAGGGGGTCCACCTTTTCCAA
AGTATGCAAACACATGTCACCCTCTTCAACATCCAGGAATGTGATTGGCTTGTAGGTGTATTTCACGTG
ACCTGGGGTCCCCGCTGGGGGGGTATAAAAGGGGGCGGTTCTTTGCTCTTCCTCACTGTCTTCCGGATC
GCTGTCCAGGAACGTCAGCTGTTGGGGTAGGTATTCCCTCTCGAAGGCGGGCATGACCTCTGCACTCAG
GTTGTCAGTTTCTAAGAACGAGGAGGATTTGATATTGACAGTGCCGGTTGAGATGCCTTTCATGAGGTT
TTCGTCCATCTGGTCAGAAAACACAATTTTTTATTGTCAAGTTTGGTGGCAAATGATCCATACAGGGC
GTTGGATAAAAGTTTGGCAATGGATCGCATGGTTTGGTTCTTTTCCTTGTCCGCGCGCTCTTTGGCGGC
GATGTTGAGTTGGACATACTCGCGTGCCAGGCACTTCCATTCGGGGAAGATAGTTGTTAATTCATCTGG
CACGATTCTCACTTGCCACCCTCGATTATGCAAGGTAATTAAATCCACACTGGTGGCCACCTCGCCTCG
AAGGGGTTCATTGGTCCAACAGAGCCTACCTCCTTTCCTAGAACAGAAAGGGGGAAGTGGGTCTAGCAT
AAGTTCATCGGGAGGGTCTGCATCCATGGTAAAGATTCCCGGAAGTAAATCCTTATCAAAATAGCTGAT
GGGAGTGGGGTCATCTAAGGCCATTTGCCATTCTCGAGCTGCCAGTGCGCGCTCATATGGGTTAAGGGG
ACTGCCCCATGGCATGGGATGGGTGAGTGCAGAGGCATACATGCCACAGATGTCATAGACGTAGATGGG
ATCCTCAAAGATGCCTATGTAGGTTGGATAGCATCGCCCCCCTCTGATACTTGCTCGCACATAGTCATA
TAGTTCATGTGATGGCGCTAGCAGCCCCGGACCCAAGTTGGTGCGATTGGGTTTTTCTGTTCTGTAGAC
GATCTGGCGAAAGATGGCGTGAGAATTGGAAGAGATGGTGGGTCTTTGAAAAATGTTGAAATGGGCATG
AGGTAGACCTACAGAGTCTCTGACAAAGTGGGCATAAGATTCTTGAAGCTTGGTTACCAGTTCGGCGGT
GACAAGTACGTCTAGGGCGCAGTAGTCAAGTGTTTCTTGAATGATGTCATAACCTGGTTGGTTTTTCTT
TTCCCACAGTTCGCGGTTGAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGGCAGCAGCCCTTCTC
TACGGGTAGAGAGTATGCTTGAGCAGCTTTTCGTAGCGAAGCGTGAGTAAGGGCAAAGGTGTCTCTGAC
CATGACTTTGAGGAATTGGTATTTGAAGTCGATGTCGTCACAGGCTCCCTGTTCCCAGAGTTGGAAGTC
TACCCGTTTCTTGTAGGCGGGGTTGGGCAAAGCGAAAGTAACATCATTGAAGAGAATCTTGCCGGCCCT
GGGCATGAAATTGCGAGTGATGCGAAAAGGCTGTGGTACTTCCGCTCGGTTATTGATAACCTGGGCAGC
TAGGACGATCTCGTCGAAACCGTTGATGTTGTGTCCTACGATGTATAATTCTATGAAACGCGGCGTGCC
TCTGACGTGAGGTAGCTTACTGAGCTCATCAAAGGTTAGGTCTGTGGGGTCAGATAAGGCGTAGTGTTC
GAGAGCCCATTCGTGCAGGTGAGGATTCGCTTTAAGGAAGGAGGACCAGAGGTCCACTGCCAGTGCTGT
TTGTAACTGGTCCCGGTACTGACGAAATGCCGTCCGACTGCCATTTTTCTGGGGTGACGCAATAGAA
GGTTTGGGGGTCCTGCCGCCAGCGATCCCACTTGAGTTTTATGGCGAGGTCATAGGCGATGTTGACGAG
CCGCTGGTCTCCAGAGAGTTTCATGACCAGCATGAAGGGGATTAGCTGCTTGCCAAAGGACCCCATCCA
GGTGTAGGTTTCCACATCGTAGGTGAGAAAGAGCCTTTCTGTGCGAGGATGAGAGCCAATCGGGAAGAA
CTGGATCTCCTGCCACCAGTTGGAGGAATGGCTGTTGATGTGATGGAAGTAGAACTCCCTGCGACGCGC
CGAGCATTCATGCTTGTGCTTGTACAGACGGCCGCAGTAGTCGCAGCGTTGCACGGGTTGTATCTCGTG
AATGAGTTGTACCTGGCTTCCCTTGACGAGAAATTTCAGTGGGAAGCCGAGGCCTGGCGATTGTATCTC
```

Figure 64 continued

```
GTGCTTTACTATGTTGTCTGCATCGGCCTGTTCATCTTCTGTCTCGATGGTGGTCATGCTGACGAGCCC
TCGCGGGAGGCAAGTCCAGACCTCGGCGCGGCAGGGGCGGAGCTCGAGGACGAGAGCGCGCAGGCTGGA
GCTGTCCAGGGTCCTGAGACGCTGCGGACTCAGGTTAGTAGGCAGTGTCAGGAGATTAACTTGCATGAT
CTTTTGGAGGGCGTGCGGGAGGTTCAGATAGTACTTGATCTCAACGGGTCCGTTGGTGGAGATGTCGAT
GGCTTGCAGGGTTCCGTGTCCCTGGGCGCTACCACCGTGCCCTTGTTTTTCATTTTGGACGGCGGTGG
CTCTGTTGCTTCTTGCATGTTTAGAAGCGGTGTCGAGGGCGCGCACCGGGCGGCAGGGGCGGCTCGGGA
CCCGGCGGCATGGCTGGCAGTGGTACGTCGGCGCCGCGCGCGGGTAGGTTCTGGTACTGCGCCCTGAGA
AGACTCGCATGCGCGACGACGCGGCGGTTGACATCCTGGATCTGACGCCTCTGGGTGAAAGCTACCGGC
CCCGTGAGCTTGAACCTGAAAGAGAGTTCAACAGAATCAATCTCGGTATCGTTGACGGCGGCTTGCCTA
AGGATTTCTTGCACGTCACCAGAGTTGTCCTGGTAGGCGATCTCCGCCATGAACTGCTCGATCTCTTCC
TCTTGAAGATCTCCGCGGCCCGCTCTCGACGGTGGCCGCGAGGTCGTTGGAGATGCGCCCAATGAGT
TGAGAGAATGCATTCATGCCCGCCTCGTTCCAGACGCGGCTGTAGACCACGGCCCCCACGGGATCTCTC
GCGCGCATGACCACCTGGGCGAGGTTGAGCTCCACGTGGCGGGTGAAGACCGCATAGTTGCATAGGCGC
TGGAAAAGGTAGTTGAGTGTGGTGGCGATGTGCTCGGTGACGAAGAAATACATGATCCATCGTCTCAGC
GGCATCTCGCTGACATCGCCCAGAGCTTCCAAGCGCTCCATGGCCTCGTAGAAGTCCACGGCAAAATTA
AAAAACTGGGAGTTTCGCGCGGACACGGTCAACTCCTCTTCCAGAAGACGGATAAGTTCGGCGATGGTG
GTGCGCACCTCGCGCTCGAAAGCCCCTGGGATTTCTTCCTCAATCTCTTCTTCTTCCACTAACATCTCT
TCCTCTTCAGGTGGGGCTGCAGGAGGAGGGGGAACGCGGCGACGCCGGCGGCGCACGGGCAGACGGTCG
ATGAATCTTTCAATGACCTCTCCGCGGCGGCGGCGCATGGTTTCAGTGACGGCGCGGCCGTTCTCGCGC
GGTCGCAGAGTAAAAACACCGCCGCGCATCTCCTTAAAGTGGTGACTGGGAGGTTCTCCGTTTGGGAGG
GAGAGGGCGCTGATTATACATTTTATTAATTGGCCCGTAGGGACTGCACGCAGAGATCTGATCGTGTCA
AGATCCACGGGATCTGAAAACCTTTCGACGAAAGCGTCTAACCAGTCACAGTCACAAGGTAGGCTGAGT
ACGGCTTCTTGTGGGCGGGGGTGGTTATGTGTTCGGTCTGGGTCTTCTGTTTCTTCTTCATCTCGGGAA
GGTGAGACGATGCTGCTGGTGATGAAATTAAAGTAGGCAGTTCTAAGACGGCGGATGGTGGCGAGGAGC
ACCAGGTCTTTGGGTCCGGCTTGCTGGATACGCAGGCGATTGGCCATTCCCCAAGCATTATCCTGACAT
CTAGCAAGATCTTTGTAGTAGTCTTGCATGAGCCGTTCTACGGGCACTTCTTCCTCACCCGTTCTGCCA
TGCATACGTGTGAGTCCAAATCCGCGCATTGGTTGTACCAGTGCCAAGTCAGCTACGACTCTTTCGGCG
AGGATGGCTTGCTGTACTTGGGTAAGGGTGGCTTGAAAGTCATCAAAATCCACAAAGCGGTGGTAAGCT
CCTGTATTAATGGTGTAAGCACAGTTGGCCATGACTGACCAGTTAACTGTCTGGTGACCAGGGCGCACG
AGCTCGGTGTATTTAAGGCGCGAATAGGCGCGGGTGTCAAAGATGTAATCGTTGCAGGTGCGCACCAGA
TACTGGTACCCTATAAGAAATGCGGCGGTGGTTGGCGGTAGAGAGGCCATCGTTCTGTAGCTGGAGCG
CCAGGGGCGAGGTCTTCCAACATAAGGCGGTGATAGCCGTAGATGTACCTGGACATCCAGGTGATTCCT
GCGGCGGTAGTAGAAGCCCGAGGAAACTCGCGTACGCGGTTCCAAATGTTGCGTAGCGGCATGAAGTAG
TTCATTGTAGGCACGGTTTGACCAGTGAGGCGCGCGCAGTCATTGATGCTCTATAGACACGGAGAAAAT
GAAAGCGTTCAGCGACTCGACTCCGTAGCCTGGAGGAACGTGAACGGGTTGGGTCGCGGTGTACCCCGG
TTCGAGACTTGTACTCGAGCCGGCCGGAGCCGCGGCTAACGTGGTATTGGCACTCCCGTCTCGACCCAG
CCTACAAAAATCCAGGATACGGAATCGAGTCGTTTTGCTGGTTTCCGAATGGCAGGGAAGTGAGTCCTA
TTTTTTTTTTTGCCGCTCAGATGCATCCCGTGCTGCGACAGATGCGCCCCAACAACAGCCCCCCTCG
CAGCAGCAGCAGCAGCAATCACAAAAGGCTGTCCCTGCAACTACTGCAACTGCCGCCGTGAGCGGTGCG
GGACAGCCCGCCTATGATCTGGACTTGGAAGAGGGCGAAGGACTGGCACGTCTAGGTGCGCCTTCACCC
GAGCGGCATCCGCGAGTTCAACTGAAAAAGATTCTCGCGAGGCGTATGTGCCCAACAGAACCTATTT
AGAGACAGAAGCGGCGAGGAGCCGGAGGAGATGCGAGCTTCCCGCTTTAACGCGGGTCGTGAGCTGCGT
CACGGTTTGGACCGAAGACGAGTGTTGCGGGACGAGGATTTCGAAGTTGATGAAATGACAGGGATCAGT
CCTGCCAGGGCACACGTGGCTGCAGCCAACCTTGTATCGGCTTACGAGCAGACAGTAAAGGAAGAGCGT
AACTTCCAAAAGTCTTTTAATAATCATGTGCGAACCCTGATTGCCCGCGAAGAAGTTACCCTTGGTTTG
ATGCATTTGTGGGATTTGATGGAAGCTATCATTCAGAACCCTACTAGCAAACCTCTGACCGCCCAGCTG
TTTCTGGTGGTGCAACACAGCAGAGACAATGAGGCTTTCAGAGAGGCGCTGCTGAACATCACCGAACCC
GAGGGGAGATGGTTGTATGATCTTATCAACATTCTACAGAGTATCATAGTGCAGGAGCGGAGCCTGGGC
CTGGCCGAGAAGGTGGCTGCCATCAATTACTCGGTTTTGAGCTTGGGAAAATATTACGCTCGCAAAATC
TACAAGACTCCATACGTTCCCATAGACAAGGAGGTGAAGATAGATGGGTTCTACATGCGCATGACGCTC
AAGGTCTTGACCCTGAGCGATGATCTTGGGGTGTATCGCAATGACAGAATGCATCGCGCGGTTAGCGCC
AGCAGGAGGCGCGAGTTAAGCGACAGGGAACTGATGCACAGTTTGCAAAGAGCTCTGACTGGAGCTGGA
```

Figure 64 continued

```
ACCGAGGGTGAGAATTACTTCGACATGGGAGCTGACTTGCAGTGGCAGCCTAGTCGCAGGGCTCTGAGC
GCCGCGACGGCAGGATGTGAGCTTCCTTACATAGAAGAGGCGGATGAAGGCGAGGAGGAAGAGGGCGAG
TACTTGGAAGACTGATGGCACAACCCGTGTTTTTGCTAGATGGAACAGCAAGCACCGGATCCCGCAAT
GCGGGCGGCGCTGCAGAGCCAGCCGTCCGGCATTAACTCCTCGGACGATTGGACCCAGGCCATGCAACG
TATCATGGCGTTGACGACTCGCAACCCCGAAGCCTTTAGACAGCAACCCCAGGCCAACCGTCTATCGGC
CATCATGGAAGCTGTAGTGCCTTCCCGCTCTAATCCCACTCATGAGAAGGTCCTGGCCATCGTGAACGC
GTTGGTGGAGAACAAAGCTATTCGTCCAGATGAGGCCGGACTGGTATACAACGCTCTCTTAGAACGCGT
GGCTCGCTACAACAGTAGCAATGTGCAAACCAATTTGGACCGTATGATAACAGATGTACGCGAAGCCGT
GTCTCAGCGCGAAAGGTTCCAGCGTGATGCCAACCTGGGTTCGCTGGTGGCGTTAAATGCTTTCTTGAG
TACTCAGCCTGCTAATGTGCCGCGTGGTCAACAGGATTATACTAACTTTTTAAGTGCTTTGAGACTGAT
GGTATCAGAAGTACCTCAGAGCGAAGTGTATCAGTCCGGTCCTGATTACTTCTTTCAGACTAGCAGACA
GGGCTTGCAGACGGTAAATCTGAGCCAAGCTTTTAAAAACCTTAAAGGTTTGTGGGGAGTGCATGCCCC
GGTAGGAGAAAGAGCAACCGTGTCTAGCTTGTTAACTCCGAACTCCCGCCTATTATTACTGTTGGTAGC
TCCTTTCACCGACAGCGGTAGCATCGACCGTAATTCCTATTTGGGTTACCTACTAAACCTGTATCGCGA
AGCCATAGGGCAAAGTCAGGTGGACGAGCAGACCTATCAAGAAATTACCCAAGTCAGTCGCGCTTTGGG
ACAGGAAGACACTGGCAGTTTGGAAGCCACTCTGAACTTCTTGCTTACCAATCGGTCTCAAAAGATCCC
TCCTCAATATGCTCTTACTGCGGAGGAGGAGAGGATCCTTAGATATGTGCAGCAGAGCGTGGGATTGTT
TCTGATGCAAGAGGGGGCAACTCCGACTGCAGCACTGGACATGACAGCGCGAAATATGGAGCCCAGCAT
GTATGCCAGTAACCGACCTTTCATTAACAAACTGCTGGACTACTTGCACAGAGCTGCCGCTATGAACTC
TGATTATTTCACCAATGCCATCTTAAACCCGCACTGGCTGCCCCCACCTGGTTTCTACACGGGCAATA
TGACATGCCCGACCCTAATGACGGATTTCTGTGGGACGACGTGGACAGCGATGTTTTTCACCTCTTTC
TGATCATCGCACGTGGAAAAGGAAGGCGGCGATAGAATGCATTCTTCTGCATCGCTGTCCGGGGTCAT
GGGTGCTACCGCGGCTGAGCCCGAGTCTGCAAGTCCTTTTCCTAGTCTACCCTTTTCTCTACACAGTGT
ACGTAGCAGCGAAGTGGGTAGAATAAGTCGCCCGAGTTTAATGGGCGAAGAGGAGTATCTAAACGATTC
CTTGCTCAGACCGGCAAGAGAAAAAAATTTCCCAAACAATGGAATAGAAAGTTTGGTGGATAAAATGAG
TAGATGGAAGACTTATGCTCAGGATCACAGAGACGAGCCTGGGATCATGGGGATTACAAGTAGAGCGAG
CCGTAGACGCCAGCGCCATGACAGACAGAGGGGTCTTGTGTGGGACGATGAGGATTCGGCCGATGATAG
CAGCGTGCTGGACTTGGGTGGGAGAGGAAGGGGCAACCCGTTTGCTCATTTGCGCCCTCGCTTGGGTGG
TATGTTGTAAAAAAAAATAAAAAAAAAACTCACCAAGGCCATGGCGACGAGCGTACGTTCGTTCTTCTT
TATTATCTGTGTCTAGTATAATGAGGCGAGTCGTGCTAGGCGGAGCGGTGGTGTATCCGGAGGGTCCTC
CTCCTTCGTACGAGAGCGTGATGCAGCAGCAGCAGGCGACGGCGGTGATGCAATCCCCACTGGAGGCTC
CCTTTGTGCCTCCGCGATACCTGGCACCTACGGAGGGCAGAAACAGCATTCGTTATTCGGAACTGGCAC
CTCAGTACGATACCACCAGGTTGTATCTGGTGGACAACAAGTCGGCGGACATTGCTTCTCTGAACTATC
AGAATGACCACAGCAACTTCTTGACCACGGTGGTGCAAAACAATGACTTTACCCCTACGGAAGCCAGCA
CCCAGACCATTAACTTTGATGAACGATCGCGGTGGGGCGGTCAGCTAAAGACCATCATGCATACTAACA
TGCCAAACGTGAACGAGTATATGTTTAGTAACAAGTTCAAAGCGCGTGTGATGGTGTCCAGAAAACCTC
CCGACGGTGCTGCAGTTGGGGATACTTATGATCACAAGCAGGATATTTTGAAATATGAGTGGTTCGAGT
TTACTTTGCCAGAAGGCAACTTTTCAGTTACTATGACTATTGATTTGATGAACAATGCCATCATAGATA
ATTACTTGAAAGTGGGTAGACAGAATGGAGTGCTTGAAAGTGACATTGGTGTTAAGTTCGACACCAGGA
ACTTCAAGCTGGGATGGGATCCCGAAACCAAGTTGATCATGCCTGGAGTGTATACGTATGAAGCCTTCC
ATCCTGACATTGTCTTACTGCCTGGCTGCGGAGTGGATTTTACCGAGAGTCGTTTGAGCAACCTTCTTG
GTATCAGAAAAAAACAGCCATTTCAAGAGGGTTTTAAGATTTTGTATGAAGATTTAGAAGGTGGTAATA
TTCCGGCCCTCTTGGATGTAGATGCCTATGAGAACAGTAAGAAAGAACAAAAAGCCAAAATAGAAGCTG
CTACAGCTGCTGCAGAAGCTAAGGCAAACATAGTTGCCAGCGACTCTACAAGGGTTGCTAACGCTGGAG
AGGTCAGAGGAGACAATTTTGCGCCAACACCTGTTCCGACTGCAGAATCATTATTGGCCGATGTGTCTG
AAGGAACGGACGTGAAACTCACTATTCAACCTGTAGAAAAGATAGTAAGAATAGAAGCTATAATGTGT
TGGAAGACAAAATCAACACAGCCATCGCAGTTGGTATCTTTCGTACAATTATGGCGATCCCGAAAAAG
GAGTGCGTTCCTGGACATTGCTCACCACCTCAGATGTCACCTGCGGAGCAGAGCAGGTCTACTGGTCGC
TTCCAGACATGATGAAGGATCCTGTCACTTTCCGCTCCACTAGACAAGTCAGTAACTACCCTGTGGTGG
GTGCAGAGCTTATGCCCGTCTTCTCAAAGAGCTTCTACAACGAACAAGCTGTGTACTCCCAGCAGCTCC
GCCAGTCCACCTCGCTTACGCACGTCTTCAACCGCTTTCCTGAGAACCAGATTTAATCCGTCCGCCGG
CGCCCACCATTACCACCGTCAGTGAAAACGTTCCTGCTCTCACAGATCACGGGACCCTGCCGTTGCGCA
```

Figure 64 continued

```
GCAGTATCCGGGGAGTCCAACGTGTGACCGTTACTGACGCCAGACGCCGCACCTGTCCCTACGTGTACA
AGGCACTGGGCATAGTCGCACCGCGCGTCCTTTCAAGCCGCACTTTCTAAAAAAAAAAAAAATGTCCAT
TCTTATCTCGCCCAGTAATAACACCGGTTGGGGTCTGCGCGCTCCAAGCAAGATGTACGGAGGCGCACG
CAAACGTTCTACCCAACATCCTGTCCGTGTTCGCGGACATTTTCGCGCTCCATGGGGCGCCCTCAAGGG
CCGCACTCGCGTTCGAACCACCGTCGATGATGTAATCGATCAGGTGGTTGCCGACGCCCGTAATTATAC
TCCTACTGCGCCTACATCTACTGTGGATGCAGTTATTGACAGTGTAGTGGCTGACGCTCGCAACTATGC
TCGACGTAAGAGCCGGCGAAGGCGCATTGCCAGACGCCACCGAGCTACCACTGCCATGCGAGCCGCAAG
AGCTCTGCTACGAAGAGCTAGACGCGTGGGGCGAAGAGCCATGCTTAGGGCGGCCAGACGTGCAGCTTC
GGGCGCCAGCGCCGGCAGGTCCCGCAGGCAAGCAGCCGCTGTCGCAGCGGCGACTATTGCCGACATGGC
CCAATCGCGAAGAGGCAATGTATACTGGGTGCGTGACGCTGCCACCGGTCAACGTGTACCCGTGCGCAC
CCGTCCCCCTCGCACTTAGAAGATACTGAGCAGTCTCCGATGTTGTGTCCCAGCGGCGAGGATGTCCAA
GCGCAAATACAAGGAAGAAATGCTGCAGGTTATCGCACCTGAAGTCTACGGCCAACCGTTGAAGGATGA
AAAAAAACCCCGCAAAATCAAGCGGGTTAAAAAGGACAAAAAAGAAGAGGAAGATGGCGATGATGGGCT
GGCGGAGTTTGTGCGCGAGTTTGCCCCACGGCGACGCGTGCAATGGCGTGGGCGCAAAGTTCGACATGT
GTTGAGACCTGGAACTTCGGTGGTCTTTACACCCGGCGAGCGTTCAAGCGCTACTTTAAGCGTTCCTA
TGATGAGGTGTACGGGGATGATGATATTCTTGAGCAGGCGGCTGACCGATTAGGCGAGTTTGCTTATGG
CAAGCGTAGTAGAATAACTTCCAAGGATGAGACAGTGTCGATACCCTTGGATCATGGAAATCCCACCCC
TAGTCTTAAACCGGTCACTTTGCAGCAAGTGTTACCCGTAACTCCGCGAACAGGTGTTAAACGCGAAGG
TGAAGATTTGTATCCCACTATGCAACTGATGGTACCCAAACGCCAGAAGTTGGAGGACGTTTTGGAGAA
AGTAAAAGTGGATCCAGATATTCAACCTGAGGTTAAAGTGAGACCCATTAAGCAGGTAGCGCCTGGTCT
GGGGGTACAAACTGTAGACATTAAGATTCCCACTGAAAGTATGGAAGTGCAAACTGAACCCGCAAAGCC
TACTGCCACCTCCACTGAAGTGCAAACGGATCCATGGATGCCCATGCCTATTACAACTGACGCCGCCGG
TCCCACTCGAAGATCCCGACGAAAGTACGGTCCAGCAAGTCTGTTGATGCCCAATTATGTTGTACACCC
ATCTATTATTCCTACTCCTGGTTACCGAGGCACTCGCTACTATCGCAGCCGAAACAGTACCTCCCGCCG
TCGCCGCAAGACACCTGCAAATCGCAGTCGTCGCCGTAGACGCACAAGCAAACCGACTCCCGGCGCCCT
GGTGCGGCAAGTGTACCGCAATGGTAGTGCGGAACCTTTGACACTGCCGCGTGCGCGTTACCATCCGAG
TATCATCACTTAATCAATGTTGCCGCTGCCTCCTTGCAGATATGGCCCTCACTTGTCGCCTTCGCGTTC
CCATCACTGGTTACCGAGGAAGAAACTCGCGCCGTAGAAGAGGGATGTTGGGACGCGGAATGCGACGCT
ACAGGCGACGGCGTGCTATCCGCAAGCAATTGCGGGGTGGTTTTTTACCAGCCTTAATTCCAATTATCG
CTGCTGCAATTGGCGCGATACCAGGCATAGCTTCCGTGGCGGTTCAGGCCTCGCAACGACATTGACATT
GGAAAAAAACGTATAAATAAAAAAAAAAAAATACAATGGACTCTGACACTCCTGGTCCTGTGACTATGT
TTTCTTAGAGATGGAAGACATCAATTTTTCATCCTTGGCTCCGCGACACGGCACGAAGCCGTACATGGG
CACCTGGAGCGACATCGGCACGAGCCAACTGAACGGGGGCGCCTTCAATTGGAGCAGTATCTGGAGCGG
GCTTAAAAATTTTGGCTCAACCATAAAAACATACGGGAACAAAGCTTGGAACAGCAGTACAGGACAGGC
GCTTAGAAATAAACTTAAAGACCAGAACTTCCAACAAAAGTAGTCGATGGGATAGCTTCCGGCATCAA
TGGAGTGGTAGATTTGGCTAACCAGGCTGTGCAGAAAAAGATAAACAGTCGTTTGGACCCGCCGCCAGC
AACCCCAGGTGAAATGCAAGTGGAGGAAGAAATTCCTCCGCCAGAAAAACGAGGCGACAAGCGTCCGCG
TCCCGATTTGGAAGAGACGCTGGTGACGCGCGTAGATGAACCGCCTTCTTATGAGGAAGCAACGAAGCT
TGGAATGCCCACCACTAGACCGATAGCCCCAATGGCCACCGGGGTGATGAAACCTTCTCAGTTGCATCG
ACCCGTCACCTTGGATTTGCCCCCTCCCCCTGCTGCTACTGCTGTACCCGCTTCTAAGCCTGTCGCTGC
CCCGAAACCAGTCGCCGTAGCCAGGTCACGTCCCGGGGCGCTCCTCGTCCAAATGCGCACTGGCAAAA
TACTCTGAACAGCATCGTGGGTCTAGGCGTGCAAAGTGTAAAACGCCGTCGCTGCTTTTAATTAAATAT
GGAGTAGCGCTTAACTTGCCTATCTGTGTATATGTGTCATTACACGCCGTCACAGCAGCAGAGGAAAAA
AGGAAGAGGTCGTGCGTCGACGCTGAGTTACTTTCAAGATGGCCACCCCATCGATGCTGCCCCAATGGG
CATACATGCACATCGCCGGACAGGATGCTTCGGAGTACCTGAGTCCGGGTCTGGTGCAGTTCGCCCGCG
CCACAGACACCTACTTCAATCTGGGAAATAAGTTTAGAAATCCCACCGTAGCGCCGACCCACGATGTGA
CCACCGACCGTAGCCAGCGGCTCATGTTGCGCTTCGTGCCCGTTGACCGGGAGGACAATACATACTCTT
ACAAAGTGCGGTACACCCTGGCCGTGGGCGACAACAGAGTGCTGGATATGGCCAGCACGTTCTTTGACA
TTAGGGGTGTGTTGGACAGAGGTCCCAGTTTCAAACCCTATTCTGGTACGGCTTACAACTCCCTGGCTC
CTAAAGGCGCTCCAAATACATCTCAGTGGATTGCAGAAGGTGTAAAAAATACAACTGGTGAGGAACACG
TAACAGAAGAGGAAACCAATACTACTACTTACACTTTTGGCAATGCTCCTGTAAAAGCTGAAGCTGAAA
TTACAAAAGAAGGACTCCCAGTAGGTTTGGAAGTTTCAGATGAAGAAAGTAAACCGATTTATGCTGATA
```

Figure 64 continued

```
AAACATATCAGCCAGAACCTCAGCTGGGAGATGAAACTTGGACTGACCTTGATGGAAAAACCGAAAAGT
ATGGAGGCAGGGCTCTCAAACCCGATACTAAGATGAAACCATGCTACGGGTCCTTTGCCAAACCTACTA
ATGTGAAAGGCGGTCAGGCAAAACAAAAAACAACGGAGCAGCCAAATCAGAAAGTCGAATATGATATCG
ACATGGAGTTTTTTGATGCGGCATCGCAGAAAACAAACTTAAGTCCTAAAATTGTCATGTATGCAGAAA
ATGTAAATTTGGAAACTCCAGACACTCATGTAGTGTACAAACCTGGAACAGAAGACACAAGTTCCGAAG
CTAATTTGGGACAACAATCTATGCCCAACAGACCCAACTACATTGGCTTCAGAGATAACTTTATTGGAC
TTATGTACTATAACAGTACTGGTAACATGGGGGTGCTGGCTGGTCAAGCGTCTCAGTTAAATGCAGTGG
TTGACTTGCAGGACAGAAACACAGAACTTTCTTACCAACTCTTGCTTGACTCTCTGGGCGACAGAACCA
GATACTTTAGCATGTGGAATCAGGCTGTGGACAGTTATGATCCTGATGTACGTGTTATTGAAAATCATG
GTGTGGAAGATGAACTTCCCAACTACTGTTTTCCACTGGACGGCATAGGTGTTCCAACAACCAGTTACA
AATCAATAGTTCCAAATGGAGACAATGCGCCTAATTGGAAGGAACCTGAAGTAAATGGAACAAGTGAGA
TCGGACAGGGTAATTTGTTTGCCATGGAAATTAACCTTCAAGCCAATCTATGGCGAAGTTTCCTTTATT
CCAATGTGGCTCTATATCTCCCAGACTCGTACAAATACACCCCGTCCAATGTCACTCTTCCAGAAAACA
AAAACACCTACGACTACATGAACGGGCGGGTGGTGCCGCCATCTCTAGTAGACACCTATGTGAACATTG
GTGCCAGGTGGTCTCTGGATGCCATGGACAATGTCAACCCATTCAACCACCACCGTAACGCTGGCTTGC
GTTACCGATCCATGCTTCTGGGTAACGGACGTTATGTGCCTTTCCACATACAAGTGCCTCAAAAATTCT
TCGCTGTTAAAAACCTGCTGCTTCTCCCAGGCTCCTACACTTATGAGTGGAACTTTAGGAAGGATGTGA
ACATGGTTCTACAGAGTTCCCTCGGTAACGACCTGCGGGTAGATGGCGCCAGCATCAGTTTCACGAGCA
TCAACCTCTATGCTACTTTTTTCCCCATGGCTCACAACACCGCTTCCACCCTTGAAGCCATGCTGCGGA
ATGACACCAATGATCAGTCATTCAACGACTACCTATCTGCAGCTAACATGCTCTACCCCATTCCTGCCA
ATGCAACCAATATTCCCATTTCCATTCCTTCTCGCAACTGGGCGGCTTTCAGAGGCTGGTCATTTACCA
GACTGAAAACCAAAGAAACTCCCTCTTTGGGGTCTGGATTTGACCCCTACTTTGTCTATTCGGTTCTA
TTCCCTACCTGGATGGTACCTTCTACCTGAACCACACTTTTAAGAAGGTTTCCATCATGTTTGACTCTT
CAGTGAGCTGGCCTGGAAATGACAGGTTACTATCTCCTAACGAATTTGAAATAAAGCGCACTGTGGATG
GCGAAGGCTACAACGTAGCCCAATGCAACATGACCAAAGACTGGTTCTTGGTACAGATGCTCGCCAACT
ACAACATCGGCTATCAGGGCTTCTACATTCCAGAAGGATACAAAGATCGCATGTATTCATTTTCAGAA
ACTTCCAGCCCATGAGCAGGCAGGTGGTTGATGAGGTCAATTACAAAGACTTCAAGGCCGTCGCCATAC
CCTACCAACACAACAACTCTGGCTTTGTGGGTTACATGGCTCCGACCATGCGCCAAGGTCAACCCATC
CCGCTAACTATCCCTATCCACTCATTGGAACAACTGCCGTAAATAGTGTTACGCAGAAAAAGTTCTTGT
GTGACAGAACCATGTGGCGCATACCGTTCTCGAGCAACTTCATGTCTATGGGGGCCCTTACAGACTTGG
GACAGAATATGCTCTATGCCAACTCAGCTCATGCTCTGGACATGACCTTTGAGGTGGATCCCATGGATG
AGCCCACCCTGCTTTATCTTCTTCGAAGTTTTCGACGTGGTCAGAGTGCATCAGCCACACCGCGGCA
TCATCGAGGCAGTCTACCTGCGTACACCGTTCTCGGCCGGTAACGCTACCACGTAAGAAGCTTCTTGCT
TCTTGCAAATAGCAGCTGCAACCATGGCCTGCGGATCCCAAAACGGCTCCAGCGAGCAAGAGCTCAGAG
CCATTGTCCAAGACCTGGGTTGCGGACCCTATTTTTTGGGAACCTACGATAAGCGCTTCCCGGGGTTCA
TGGCCCCCGATAAGCTCGCCTGTGCCATTGTAAATACGGCCGGACGTGAGACGGGGGGAGAGCACTGGT
TGGCTTTCGGTTGGAACCCACGTTCTAACACCTGCTACCTTTTGATCCTTTTGGATTCTCGGATGATC
GTCTCAAACAGATTTACCAGTTTGAATATGAGGGTCTCCTGCGCCGCAGCGCTCTTGCTACCAAGGACC
GCTGTATTACGCTGGAAAAATCTACCCAGACCGTGCAGGGTCCCCGTTCTGCCGCCTGCGGACTTTTCT
GCTGCATGTTCCTTCACGCCTTTGTGCACTGGCCTGACCGTCCCATGGACGGAAACCCCACCATGAAAT
TGCTAACTGGAGTGCCAAACAACATGCTTCATTCTCCTAAAGTCCAGCCCACCCTGTGTGACAATCAAA
AAGCACTCTACCATTTTCTTAATACCCATTCGCCTTATTTTCGCTCCCATCGTACACACATCGAAAGGG
CCACTGCGTTCGACCGTATGGATGTTCAATAATGACTCATGTAAACAACGTGTTCAATAAACATCACTT
TATTTTTTACATGTATCAAGGCTCTGCATTACTTATTTATTTACAAGTCGAATGGGTTCTGACGAGAA
TCAGAATGACCCGCAGGCAGTGATACGTTGCGGAACTGATACTTGGGTTGCCACTTGAATTCGGGAATC
ACCAACTTGGGAACCGGTATATCGGGCAGGATGTCACTCCACAGCTTTCTGGTCAGCTGCAAAGCTCCA
AGCAGGTCAGGAGCCGAAATCTTGAAATCACAATTAGGACCAGTGCTTTGAGCGCGAGAGTTGCGGTAC
ACCGGATTGCAGCACTGAAACACCATCAGCGACGGATGTCTCACGCTTGCCAGCACGGTGGGATCTGCA
ATCATGCCCACATCCAGATCTTCAGCATTGGCAATGCTGAACGGGGTCATCTTGCAGGTCTGCCTACCC
ATGGCGGGCACCCAATTAGGCTTGTGGTTGCAATCGCAGTGCAGGGGGATCAGTATCATCTTGGCCTGA
TCCTGTCTGATTCCTGGATACACGGCTCTCATGAAAGCATCATATTGCTTGAAAGCCTGCTGGGCTTTA
CTACCCTCGGTATAAAACATCCCGCAGGACCTGCTCGAAAACTGGTTAGCTGCACAGCCGGCATCATTC
```

Figure 64 continued

```
ACACAGCAGCGGGCGTCATTGTTAGCTATTTGCACCACACTTCTGCCCCAGCGGTTTTGGGTGATTTTG
GTTCGCTCGGGATTCTCCTTTAAGGCTCGTTGTCCGTTCTCGCTGGCCACATCCATCTCGATAATCTGC
TCCTTCTGAATCATAATATTGCCATGCAGGCACTTCAGCTTGCCCTCATAATCATTGCAGCCATGAGGC
CACAACGCACAGCCTGTACATTCCCAATTATGGTGGGCGATCTGAGAAAAGAATGTATCATTCCCTGC
AGAAATCTTCCCATCATCGTGCTCAGTGTCTTGTGACTAGTGAAAGTTAACTGGATGCCTCGGTGCTCC
TCGTTTACGTACTGGTGACAGATGCGCTTGTATTGTTCGTGTTGCTCAGGCATTAGTTTAAAAGAGGTT
CTAAGTTCGTTATCCAGCCTGTACTTCTCCATCAGCAGACACATCACTTCCATGCCTTTCTCCCAAGCA
GACACCAGGGGCAAGCTAATCGGATTCTTAACAGTGCAGGCAGCAGCTCCTTTAGCCAGAGGGTCATCT
TTAGCGATCTTCTCAATGCTTCTTTTGCCATCCTTCTCAACGATGCGCACGGGCGGGTAGCTGAAACCC
ACTGCTACAAGTTGCGCCTCTTCTCTTTCTTCGCTGTCTTGACTGATGTCTTGCATGGGGATATGT
TTGGTCTTCCTTGGCTTCTTTTTGGGGGGTATCGGAGGAGGAGGACTGTCGCTCCGTTCCGGAGACAGG
GAGGATTGTGACGTTTCGCTCACCATTACCAACTGACTGTCGGTAGAAGAACCTGACCCCACACGGCGA
CAGGTGTTTCTCTTCGGGGGCAGAGGTGGAGGCGATTGCGAAGGGCTGCGGTCCGACCTGGAAGGCGGA
TGACTGGCAGAACCCCTTCCGCGTTCGGGGGTGTGCTCCCTGTGGCGGTCGCTTAACTGATTTCCTTCG
CGGCTGGCCATTGTGTTCTCCTAGGCAGAGAAACAACAGACATGGAAACTCAGCCATTGCTGTCAACAT
CGCCACGAGTGCCATCACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATGACATGCAGAATAAAA
AAGCGAAAGAGTCTGAGACAGACATCGAGCAAGACCCGGGCTATGTGACACCGGTGGAACACGAGGAAG
AGTTGAAACGCTTTCTAGAGAGAGAGGATGAAAACTGCCCAAAACAACGAGCAGATAACTATCACCAAG
ATGCTGGAAATAGGGATCAGAACACCGACTACCTCATAGGGCTTGACGGGAAGACGCGCTCCTTAAAC
ATCTAGCAAGACAGTCGCTCATAGTCAAGGATGCATTATTGGACAGAACTGAAGTGCCCATCAGTGTGG
AAGAGCTCAGCCGCGCCTACGAGCTTAACCTCTTTTCACCTCGTACTCCCCCCAAACGTCAGCCAAACG
GCACCTGCGAGCCAAATCCTCGCTTAAACTTTTATCCAGCTTTTGCTGTGCCAGAAGTACTGGCTACCT
ATCACATCTTTTTTAAAAATCAAAAAATTCCAGTCTCCTGCCGCGCTAATCGCACCCGCGCCGATGCCC
TACTCAATCTGGGACCTGGTTCACGCTTACCTGATATAGCTTCCTTGGAAGAGGTTCCAAAGATCTTCG
AGGGTCTGGGCAATAATGAGACTCGGGCCGCAAATGCTCTGCAAAAGGGAGAAAATGGCATGGATGAGC
ATCACAGCGTTCTGGTGGAATTGGAAGGCGATAATGCCAGACTCGCAGTACTCAAGCGAAGCATCGAGG
TCACACACTTCGCATATCCCGCTGTCAACCTGCCCCCTAAAGTCATGACGGCGGTCATGGACCAGTTAC
TCATTAAGCGCGCAAGTCCCCTTTCAGAAGACATGCATGACCCAGATGCCTGTGATGAGGGTAAACCAG
TGGTCAGTGATGAGCAGCTAACCCGATGGCTGGGCACCGACTCTCCCAGGGATTTGGAAGAGCGTCGCA
AGCTTATGATGGCCGTGGTGCTGGTTACCGTAGAACTAGAGTGTCTCCGACGTTTCTTTACCGATTCAG
AAACCTTGCGCAAACTCGAAGAGAATCTGCACTACACTTTTAGACACGGCTTTGTGCGGCAGGCATGCA
AGATATCTAACGTGGAACTCACCAACCTGGTTCCTACATGGGTATTCTGCATGAGAATCGCCTAGGAC
AAAGCGTGCTGCACAGCACCCTGAAGGGGGAAGCCCGCCGTGATTACATCCGCGATTGTGTCTATCTGT
ACCTGTGCCACACGTGGCAAACCGGCATGGGTGTATGGCAGCAATGTTTAGAAGAACAGAACTTGAAAG
AGCTTGACAAGCTCTTACAGAAATCTCTTAAGGTTCTGTGGACAGGGTTCGACGAGCGCACCGTCGCTT
CCGACCTGGCAGACCTCATCTTCCCAGAGCGTCTCAGGGTTACTTTGCGAAACGGATTGCCTGACTTTA
TGAGCCAGAGCATGCTTAACAATTTTCGCTCTTTCATCCTGGAACGCTCCGGTATCCTGCCCGCCACCT
GCTGCGCACTGCCCTCCGACTTTGTGCCTCTCACCTACCGCGAGTGCCCCCGCCGCTATGGAGTCACT
GCTACCTGTTCCGTCTGGCCAACTATCTCTCCTACCACTCGGATGTGATCGAGGATGTGAGCGGAGACG
GCTTGCTGGAGTGTCACTGCCGCTGCAATCTGTGCACGCCCACCGGTCCCTAGCTTGCAACCCCAGT
TGATGAGCGAAACCCAGATAATAGGCACCTTTGAATTGCAAGGCCCCAGCAGCCAAGGCGATGGGTCTT
CTCCTGGGCAAAGTTTAAAACTGACCCCGGGACTGTGGACCTCCGCCTACTTGCGCAAGTTTGCTCCGG
AAGATTACCACCCCTATGAAATCAAGTTCTATGAGGACCAATCACAGCCTCCAAAGGCCGAACTTTCGG
CCTGCGTCATCACCCAGGGGCAATTCTGGCCCAATTGCAAGCCATCCAAAAATCCCGCCAAGAATTTC
TACTGAAAAGGGTAAGGGGTCTACCTTGACCCCAGACCGGCGAGGAACTCAACACAAGGTTCCCTC
AGGATGTCCCAACGACGAGAAAACAAGAAGTTGAAGGTGCAGCCGCCGCCCCAGAAGATATGGAGGAA
GATTGGGACAGTCAGGCAGAGGAGGCGGAGGAGGACAGTCTGGAGGACAGTCTGGAGGAAGACAGTTTG
GAGGAGGAAAACGAGGAGGCAGAGGAGGTGGAAGAAGTAACCGCCGACAAACAGTTATCCTCGGCTGCG
GAGACAAGCAACAGCGCTACCATCTCCGCTCCGAGTCGAGGAACCCGGCGGCGTCCCAGCAGTAGATGG
GACGAGACCGGACGCTTCCCGAACCCAACCAGCGCTTCCAAGACCGGTAAGAAGGATCGGCAGGGATAC
AAGTCCTGGCGGGGCATAAGAATGCCATCATCTCCTGCTTGCATGAGTGCGGGGGCAACATATCCTTC
```

Figure 64 continued

```
ACGCGGCGCTACTTGCTATTCCACCATGGGGTGAACTTTCCGCGCAATGTTTTGCATTACTACCGTCAC
CTCCACAGCCCCTACTATAGCCAGCAAATCCCGGCAGTCTCGACAGATAAAGACAGCGGCGGCGACCTC
CAACAGAAAACCAGCAGCGGCAGTTAGAAAATACACAACAAGTGCAGCAACAGGAGGATTAAAGATTAC
AGCCAACGAGCCAGCGCAAACCCGAGAGTTAAGAAATCGGATCTTTCCAACCCTGTATGCCATCTTCCA
GCAGAGTCGGGGTCAAGAGCAGGAACTGAAAATAAAAAACCGATCTCTGCGTTCGCTCACCAGAAGTTG
TTTGTATCACAAGAGCGAAGATCAACTTCAGCGCACTCTCGAGGACGCCGAGGCTCTCTTCAACAAGTA
CTGCGCGCTGACTCTTAAAGAGTAGGCAGCGACCGCGCTTATTCAAAAAGGCGGGAATTACATCATCC
TCGACATGAGTAAAGAAATTCCCACGCCTTACATGTGGAGTTATCAACCCCAAATGGGATTGGCGGCAG
GCGCCTCCCAGGACTACTCCACCCGCATGAATTGGCTCAGCGCCGGGCCTTCTATGATTTCTCGAGTTA
ATGATATACGCGCCTACCGAAACCAAATACTTTTGGAACAGTCAGCTCTTACCACCACGCCCCGCCAAC
ACCTTAATCCCAGAAATTGGCCCGCCGCCCTAGTGTACCAGGAAAGTCCCGCTCCCACCACTGTATTAC
TTCCTCGAGACGCCCAGGCCGAAGTCCAAATGACTAATGCAGGTGCGCAGTTAGCTGGCGGCTCCACCC
TATGTCGTCACAGGCCTCGGCATAATATAAAACGCCTGATGATCAGAGGCCGAGGTATCCAGCTCAACG
ACGAGTCGGTGAGCTCTCCGCTTGGTCTACGACCAGACGGAATCTTTCAGATTGCCGGCTGCGGGAGAT
CTTCCTTCACCCCTCGTCAGGCTGTTCTGACTTTGGAAAGTTCGTCTTCGCAACCCCGCTCGGGCGGAA
TCGGGACCGTTCAATTTGTGGAGGAGTTTACTCCCTCTGTCTACTTCAACCCCTTCTCCGGATCTCCTG
GGCATTACCCGGACGAGTTCATACCGAACTTCGACGCGATTAGCGAGTCAGTGGACGGCTACGATTGAT
GTCTGGTGACGCGGCTGAGCTATCTCGGCTGCGACATCTAGACCACTGCCGCCGCTTTCGCTGCTTTGC
CCGGGAACTCATTGAGTTCATCTACTTCGAACTCCCCAAGGATCACCCTCAAGGTCCGGCCCACGGAGT
GCGGATTTCTATCGAAGGCAAAATAGACTCTCGCCTGCAACGAATTTTCTCCCAGCGGCCCGTGCTGAT
CGAGCGAGACCAGGGAAACACCACGGTTTCCATCTACTGCATTTGTAATCACCCCGGATTGCATGAAAG
CCTTTGCTGTCTTATGTGTACTGAGTTTAATAAAAACTGAATTAAGACTCTCCTACGGACTGCCGCTTC
TTCAACCCGGATTTTACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTTCCCTACTAATACTA
CTTTCAAAACCGGAGGTGAGCTCCAAGGTCTTCCTACAGAAAACCCTTGGGTGGAAGCGGGCCTTGTAG
TGCTAGGAATTCTTGCGGGTGGGCTTGTGATTATTCTTTGCTACCTATACACACCTTGCTTCACTTTCT
TAGTGGTGTTGTGGTATTGGTTTAAAAAATGGGGCCCATACTAGTCTTGCTTGTTTTACTTTCGCTTTT
GGAACCGGGTTCTGCCAATTACGATCCATGTCTAGACTTCGACCCAGAAAACTGCACACTTACTTTTGC
ACCCGACACAAGCCGCATCTGTGGAGTTCATCGCCTCTCTTACGAACTTGGCCCCAACGACAAAAATT
TACCTGCATGGTGGGAATCAACCCCATAGTTATCACCCAGCAAAGTGGAGATACTAAGGGTTGCATTCA
CTGCTCCTGCGATTCCATCGAGTGCACCTACACCCTGCTGAAGACCCTATGCGGCCTAAGAGACCTGCT
ACCAATGAATTAAAAAATGATTAATAAAAAATCACTTACTTGAAATCAGCAATAAGGTCTCTGTTGAAA
TTTTCTCCCAGCAGCACCTCACTTCCCTCTTCCCAACTCTGGTATTCTAAACCCCGTTCAGCGGCATAC
TTTCTCCATACTTTAAAGGGGATGTCAAATTTTAGCTCCTCTCCTGTACCCACAATCTTCATGTCTTTC
TTCCCAGATGACCAAGAGAGTCCGGCTCAGTGACTCCTTCAACCCTGTCTACCCCTATGAAGATGAAAG
CACCTCCCAACACCCCTTTATAAACCCAGGGTTTATTTCCCCAAATGGCTTCACACAAAGCCCAAACGG
AGTTCTTACTTTAAAATGTTTAACCCCACTAACAACCACAGGCGGATCTCTACAGCTAAAAGTGGGAGG
GGGACTTACAGTGGATGACACCAACGGTTTTTTGAAAGAAAACATAAGTGCCACCACACCACTCGTTAA
GACTGGTCACTCTATAGGTTTACCACTAGGAGCCGGATTGGGAACGAATGAAAATAAACTTTGTATCAA
ATTAGGACAAGGACTTACATTCAATTCAAACAACATTTGCATTGATGACAATATTAACACCTTATGGAC
AGGAGTCAACCCCACCGAAGCCAACTGTCAAATCATGAACTCCAGTGAATCTAATGATTGCAAATTAAT
TCTAACACTAGTTAAAACTGGAGCACTAGTCACTGCATTTGTTTATGTTATAGGAGTATCTAACAATTT
TAATATGCTAACTACACACAGAAATATAAATTTACTGCAGAGCTGTTTTTCGATTCTACTGGTAATTT
ACTAACTAGACTCTCATCCCTCAAAACTCCACTTAATCATAAATCAGGACAAAACATGGCTACTGGTGC
CATTACTAATGCTAAAGGTTTCATGCCCAGCACGACTGCCTATCCTTTCAATGATAATTCTAGAGAAAA
AGAAAACTACATTTACGGAACTTGTTACTACACAGCTAGTGATCGCACTGCTTTTCCCATTGACATATC
TGTCATGCTTAACCGAAGAGCAATAAATGACGAGACATCATATTGTATTCGTATAACTTGGTCCTGGAA
CACAGGAGATGCCCCAGAGGTGCAAACCTCTGCTACAACCCTAGTCACCTCCCCATTTACCTTTTACTA
CATCAGAGAAGACGACTGACAAATAAAGTTTGCGATCGCCAGGCCCACCATGGGATGGAGCTGTATCAT
CCTCTTCTTGGTAGCAACAGCTACAGGTGTCCACTCCCAGGTGCAGCTGCAGCAGTCTGGGGCTGAACT
GGCAAGACCTGGGGCCTCAGTGAAGATGTCCTGCAAGGCTTCTGGCTACACCTTTACTAGGTACACGAT
GCACTGGGTAAAACAGAGGCCTGGACAGGGTCTGGAATGGATTGGATACATTAATCCTAGCCGTGGTTA
```

Figure 64 continued

```
TACTAATTACAATCAGAAGTTCAAGGACAAGGCCACATTGACTACAGACAAATCCTCCAGCACAGCCTA
CATGCAACTGAGCAGCCTGACATCTGAGGACTCTGCAGTCTATTACTGTGCAAGATATTATGATGATCA
TTACTGCCTTGACTACTGGGGCCAAGGCACCACTCTCACAGTCTCCTCAGGTGGCGGTGGCTCGGGCGG
TGGTGGATCTGGTGGCGGCGGATCTGATATCGTGCTCACTCAGTCTCCAGCAATCATGTCTGCATCTCC
AGGGGAGAAGGTCACCATGACCTGCAGTGCCAGCTCAAGTGTAAGTTACATGAACTGGTACCAGCAGAA
GTCAGGCACCTCCCCCAAAAGATGGATTTATGACACATCCAAACTGGCTTCTGGAGTCCCTGCTCACTT
CAGGGGCAGTGGGTCTGGGACCTCTTACTCTCTCACAATCAGCGGCATGGAGGCTGAAGATGCTGCCAC
TTATTACTGCCAGCAGTGGAGTAGTAACCCATTCACGTTCGGCTCGGGGACAAAGTTGGAAATAAACCG
GGGATCCGAACAAAAACTCATCTCAGAAGAGGATCTGAATGCTGTGGGCCAGGACACGCAGGAGGTCAT
CGTGGTGCCACACTCCTTGCCCTTTAAGGTGGTGGTGATCTCAGCCATCCTGGCCCTGGTGGTGCTCAC
CATCATCTCCCTTATCATCCTCATCATGCTTTGGCAGAAGAAGCCACGTGGAAGCGGAGCTACTAACTT
CAGCCTGCTGAAGCAGGCTGGAGACGTGGAGGAGAACCCTGGACCTGGCCACACACGGAGGCAGGGAAC
ATCACCATCCAAGTGTCCATACCTCAATTTCTTTCAGCTCTTGGTGCTGGCTGGTCTTTCTCACTTCTG
TTCAGGTGTTATCCACGTGACCAAGGAAGTGAAAGAAGTGGCAACGCTGTCCTGTGGTCACAATGTTTC
TGTTGAAGAGCTGGCACAAACTCGCATCTACTGGCAAAAGGAGAAGAAAATGGTGCTGACTATGATGTC
TGGGGACATGAATATATGGCCCGAGTACAAGAACCGGACCATCTTTGATATCACTAATAACCTCTCCAT
TGTGATCCTGGCTCTGCGCCCATCTGACGAGGGCACATACGAGTGTGTTGTTCTGAAGTATGAAAAAGA
CGCTTTCAAGCGGGAACACCTGGCTGAAGTGACGTTATCAGTCAAAGCTGACTTCCCTACACCTAGTAT
ATCTGACTTTGAAATTCCAACTTCTAATATTAGAAGGATAATTTGCTCAACCTCTGGAGGTTTTCCAGA
GCCTCACCTCTCCTGGTTGGAAAATGGAGAAGAATTAAATGCCATCAACACAACAGTTTCCCAAGATCC
TGAAACTGAGCTCTATGCTGTTAGCAGCAAACTGGATTTCAATATGACAACCAACCACAGCTTCATGTG
TCTCATCAAGTATGGACATTTAAGAGTGAATCAGACCTTCAACTGGAATACAACCAAGCAAGAGCATTT
TCCTGATAACCTGCTCCCATCCTGGGCCATTACCTTAATCTCAGTAAATGGAATTTTTGTGATATGCTG
CCTGACCTACTGCTTTGCCCCAAGATGCAGAGAGAGAAGGAGGAATGAGAGATTGAGAAGGGAAAGTGT
ACGCCCTGTATAAGCTAGCTTGACTGACTGAGATACAGCGTACCTTCAGCTCACAGACATGATAAGATA
CATTGATGAGTTTGGACAAACCACAACTAGAATGCAGTGAAAAAAATGCTTTATTTGTGAAATTTGTGA
TGCTATTGCTTTATTTGTAACCATTATAAGCTGCAATAAACAAGTTAACAACAACAATTGCATTCATTT
TATGTTTCAGGTTCAGGGGGAGGTGTGGGAGGTTTTTAAAGCAAGTAAAACCTCTACAAATGTGGTAG
TCGTCAGCTATCCTGCAGGAACTTGTTTATTTGAAAATCAATTCACAAAATCCGAGTAGTTATTTTGCC
TCCCCCTTCCCATTTAACAGAATACACCAATCTCTCCCCACGCACAGCTTTAAACATTTGGATACCATT
AGATATAGACATGGTTTTAGATTCCACATTCCAAACAGTTTCAGAGCGAGCCAATCTGGGGTCAGTGAT
AGATAAAAATCCATCGGGATAGTCTTTTAAAGCGCTTTCACAGTCCAACTGCTGCGGATGCGACTCCGG
AGTCTGGATCACGGTCATCTGGAAGAAGAACGATGGGAATCATAATCCGAAAACGGTATCGGACGATTG
TGTCTCATCAAACCCACAAGCAGCCGCTGTCTGCGTCGCTCCGTGCGACTGCTGTTTATGGGATCAGGG
TCCACAGTGTCCTGAAGCATGATTTTAATAGCCCTTAACATCAACTTTCTGGTGCGATGCGCGCAGCAA
CGCATTCTGATTTCACTCAAATCTTTGCAGTAGGTACAACACATTATTACAATATTGTTTAATAAACCA
TAATTAAAAGCGCTCCAGCCAAAACTCATATCTGATATAATCGCCCCTGCATGACCATCATACCAAAGT
TTAATATAAATTAAATGACGTTCCCTCAAAAACACACTACCCACATACATGATCTCTTTTGGCATGTGC
ATATTAACAATCTGTCTGTACCATGGACAACGTTGGTTAATCATGCAACCCAATATAACCTTCCGGAAC
CACACTGCCAACACCGCTCCCCAGCCATGCATTGAAGTGAACCCTGCTGATTACAATGACAATGAAGA
ACCCAATTCTCTCGACCGTGAATCACTTGAGAATGAAAAATATCTATAGTGGCACAACATAGACATAAA
TGCATGCATCTTCTCATAATTTTTAACTCCTCAGGATTTAGAAACATATCCCAGGGAATAGGAAGCTCT
TGCAGAACAGTAAAGCTGGCAGAACAAGGAAGACCACGAACACAACTTACACTATGCATAGTCATAGTA
TCACAATCTGGCAACAGCGGGTGGTCTTCAGTCATAGAAGCTCGGGTTTCATTTTCCTCACAACGTGGT
AACTGGGCTCTGGTGTAAGGGTGATGTCTGGCGCATGATGTCGAGCGTGCGCGCAACCTTGTCATAATG
GAGTTGCTTCCTGACATTCTCGTATTTGTATAGCAAAACGCGGCCCTGGCAGAACACACTCTTCTTCG
CCTTCTATCCTGCCGCTTAGCGTGTTCCGTGTGATAGTTCAAGTACAACCACACTCTTAAGTTGGTCAA
AAGAATGCTGGCTTCAGTTGTAATCAAAACTCCATCGCATCTAATCGTTCTGAGGAAATCATCCAAGCA
ATGCAACTGGATTGTGTTTCAAGCAGGAGAGGAGAGGGAAGAGACGGAAGAACCATGTTAATTTTTATT
CCAAACGATCTCGCAGTACTTCAAATTGTAGATCGCGCAGATGGCATCTCTCGCCCCACTGTGTTGGT
GAAAAAGCACAGCTAGATCAAAAGAAATGCGATTTTCAAGGTGCTCAACGGTGGCTTCCAGCAAAGCCT
CCACGCGCACATCCAAGAACAAAAGAATACCAAAAGAAGGAGCATTTTCTAACTCCTCAATCATCATAT
```

Figure 64 continued

```
TACATTCCTGCACCATTCCCAGATAATTTTCAGCTTTCCAGCCTTGAATTATTCGTGTCAGTTCTTGTG
GTAAATCCAATCCACACATTACAAACAGGTCCCGGAGGGCGCCCTCCACCACCATTCTTAAACACACCC
TCATAATGACAAAATATCTTGCTCCTGTGTCACCTGTAGCGAATTGAGAATGGCAACATCAATTGACAT
GCCCTTGGCTCTAAGTTCTTCTTTAAGTTCTAGTTGTAAAAACTCTCTCATATTATCACCAAACTGCTT
AGCCAGAAGCCCCCGGGAACAAGAGCAGGGGACGCTACAGTGCAGTACAAGCGCAGACCTCCCCAATT
GGCTCCAGCAAAAACAAGATTGGAATAAGCATATTGGGAACCGCCAGTAATATCATCGAAGTTGCTGGA
AATATAATCAGGCAGAGTTTCTTGTAAAAATTGAATAAAAGAAAAATTTGCCAAAAAAACATTCAAAAC
CTCTGGGATGCAAATGCAATAGGTTACCGCGCTGCGCTCCAACATTGTTAGTTTTGAATTAGTCTGCAA
AAATAAAAAAAAAAACAAGCGTCATATCATAGTAGCCTGACGAACAGATGGATAAATCAGTCTTTCCAT
CACAAGACAAGCCACAGGGTCTCCAGCTCGACCCTCGTAAAACCTGTCATCATGATTAAACAACAGCAC
CGAAAGTTCCTCGCGGTGACCAGCATGAATAATTCTTGATGAAGCATACAATCCAGACATGTTAGCATC
AGTTAACGAGAAAAAACAGCCAACATAGCCTTTGGGTATAATTATGCTTAATCGTAAGTATAGCAAAGC
CACCCCTCGCGGATACAAAGTAAAAGGCACAGGAGAATAAAAAATATAATTATTTCTCTGCTGCTGTTC
AGGCAACGTCGCCCCCGGTCCCTCTAAATACACATACAAAGCCTCATCAGCCATGGCTTACCAGACAAA
GTACAGCGGGCACACAAAGCACAAGCTCTAAAGTGACTCTCCAACCTCTCCACAATATATATACACA
AGCCCTAAACTGACGTAATGGGAGTAAAGTGTAAAAAATCCCGCCAAACCCAACACACACCCGAAACT
GCGTCACCAGGGAAAAGTACAGTTTCACTTCCGCAATCCCAACAGGCGTAACTTCCTCTTTCTCACGGT
ACGTGATATCCCACTAACTTGCAACGTCATTTTCCCACGGTCGCACCGCCCCTTTTAGCCGTTAACCCC
ACAGCCAATCACCACACGATCCACACTTTTTAAAATCACCTCATTTACATATTGGCACCATTCCATCTA
TAAGGTATATTATATAGATAGA
```

SEQ ID NO: 101 V5 TAG
IPNPLLGLD

Figure 65
SEQUENCE ID NO. 102 NG-348A virus genome sequence comprising the EnAd genome with a transgene cassette that encodes a membrane-anchored chimeric form of the single chain Fv anti-human CD3e with C-terminal V5 tag and the T lymphocyte activation antigen, CD80 inserted in the region Bγ. The transgene cassette contains a 5' SSA, membrane-anchored anti-CD3ε cDNA sequence, V5 tag, P2A peptide, human CD80 cDNA sequence and a 3' poly(A) sequence

```
TCTATCTATATAATATACCTTATAGATGGAATGGTGCCAATATGTAAATGAGGTGATTTTAAAAAGTGT
GGATCGTGTGGTGATTGGCTGTGGGGTTAACGGCTAAAAGGGGCGGTGCGACCGTGGGAAAATGACGTT
TTGTGGGGGTGGAGTTTTTTTGCAAGTTGTCGCGGGAAATGTGACGCATAAAAAGGCTTTTTTCTCACG
GAACTACTTAGTTTTCCCACGGTATTTAACAGGAAATGAGGTAGTTTTGACCGGATGCAAGTGAAAATT
GTTGATTTTCGCGCGAAAACTGAATGAGGAAGTGTTTTTCTGAATAATGTGGTATTTATGGCAGGGTGG
AGTATTTGTTCAGGGCCAGGTAGACTTTGACCCATTACGTGGAGGTTTCGATTACCGTGTTTTTTACCT
GAATTTCCGCGTACCGTGTCAAAGTCTTCTGTTTTTACGTAGGTGTCAGCTGATCGCTAGGGTATTTAT
ACCTCAGGGTTTGTGTCAAGAGGCCACTCTTGAGTGCCAGCGAGAAGAGTTTTCTCCTCTGCGCCGGCA
GTTTAATAATAAAAAAATGAGAGATTTGCGATTTCTGCCTCAGGAAATAATCTCTGCTGAGACTGGAAA
TGAAATATTGGAGCTTGTGGTGCACGCCCTGATGGGAGACGATCCGGAGCCACCTGTGCAGCTTTTTGA
GCCTCCTACGCTTCAGGAACTGTATGATTTAGAGGTAGAGGGATCGGAGGATTCTAATGAGGAAGCTGT
AAATGGCTTTTTTACCGATTCTATGCTTTTAGCTGCTAATGAAGGGTTAGAATTAGATCCGCCTTTGGA
CACTTTTGATACTCCAGGGGTAATTGTGGAAAGCGGTACAGGTGTAAGAAAATTACCTGATTTGAGTTC
CGTGGACTGTGATTTGCACTGCTATGAAGACGGGTTTCCTCCGAGTGATGAGGAGGACCATGAAAAGGA
GCAGTCCATGCAGACTGCAGCGGGTGAGGGAGTGAAGGCTGCCAATGTTGGTTTTCAGTTGGATTGCCC
GGAGCTTCCTGGACATGGCTGTAAGTCTTGTGAATTTCACAGGAAAATACTGGAGTAAAGGAACTGTT
ATGTTCGCTTTGTTATATGAGAACGCACTGCCACTTTATTTACAGTAAGTGTGTTTAAGTTAAAATTTA
AAGGAATATGCTGTTTTTCACATGTATATTGAGTGTGAGTTTTGTGCTTCTTATTATAGGTCCTGTGTC
TGATGCTGATGAATCACCATCTCCTGATTCTACTACCTCACCTCCTGAGATTCAAGCACCTGTTCCTGT
GGACGTGCGCAAGCCCATTCCTGTGAAGCTTAAGCCTGGGAAACGTCCAGCAGTGGAAAACTTGAGGA
CTTGTTACAGGGTGGGGACGGACCTTTGGACTTGAGTACACGGAAACGTCCAAGACAATAAGTGTTCCA
```

Figure 65 continued

```
TATCCGTGTTTACTTAAGGTGACGTCAATATTTGTGTGACAGTGCAATGTAATAAAAATATGTTAACTG
TTCACTGGTTTTTATTGCTTTTTGGGCGGGGACTCAGGTATATAAGTAGAAGCAGACCTGTGTGGTTAG
CTCATAGGAGCTGGCTTTCATCCATGGAGGTTTGGGCCATTTTGGAAGACCTTAGGAAGACTAGGCAAC
TGTTAGAGAACGCTTCGGACGGAGTCTCCGGTTTTTGGAGATTCTGGTTCGCTAGTGAATTAGCTAGGG
TAGTTTTTAGGATAAAACAGGACTATAAACAAGAATTTGAAAAGTTGTTGGTAGATTGCCCAGGACTTT
TTGAAGCTCTTAATTTGGGCCATCAGGTTCACTTTAAAGAAAAAGTTTTATCAGTTTTAGACTTTTCAA
CCCCAGGTAGAACTGCTGCTGCTGTGGCTTTTCTTACTTTTATATTAGATAAATGGATCCCGCAGACTC
ATTTCAGCAGGGGATACGTTTTGGATTTCATAGCCACAGCATTGTGGAGAACATGGAAGGTTCGCAAGA
TGAGGACAATCTTAGGTTACTGGCCAGTGCAGCCTTTGGGTGTAGCGGGAATCCTGAGGCATCCACCGG
TCATGCCAGCGGTTCTGGAGGAGGAACAGCAAGAGGACAACCCGAGAGCCGGCCTGGACCCTCCAGTGG
AGGAGGCGGAGTAGCTGACTTGTCTCCTGAACTGCAACGGGTGCTTACTGGATCTACGTCCACTGGACG
GGATAGGGGCGTTAAGAGGGAGAGGGCATCTAGTGGTACTGATGCTAGATCTGAGTTGGCTTTAAGTTT
AATGAGTCGCAGACGTCCTGAAACCATTTGGTGGCATGAGGTTCAGAAAGAGGGAAGGGATGAAGTTTC
TGTATTGCAGGAGAAATATTCACTGGAACAGGTGAAAACATGTTGGTTGGAGCCTGAGGATGATTGGGA
GGTGGCCATTAAAAATTATGCCAAGATAGCTTTGAGGCCTGATAAACAGTATAAGATTACTAGACGGAT
TAATATCCGGAATGCTTGTTACATATCTGGAAATGGGGCTGAGGTGGTAATAGATACTCAAGACAAGGC
AGTTATTAGATGCTGCATGATGGATATGTGGCCTGGGGTAGTCGGTATGGAAGCAGTAACTTTTGTAAA
TGTTAAGTTTAGGGGAGATGGTTATAATGGAATAGTGTTTATGGCCAATACCAAACTTATATTGCATGG
TTGTAGCTTTTTGGTTTCAACAATACCTGTGTAGATGCCTGGGGACAGGTTAGTGTACGGGATGTAG
TTTCTATGCGTGTTGGATTGCCACAGCTGGCAGAACCAAGAGTCAATTGTCTCTGAAGAAATGCATATT
TCAAAGATGTAACCTGGGCATTCTGAATGAAGGCGAAGCAAGGGTCCGCCACTGCGCTTCTACAGATAC
TGGATGTTTTATTTTGATTAAGGGAAATGCCAGCGTAAAGCATAACATGATTTGCGGTGCTTCCGATGA
GAGGCCTTATCAAATGCTCACTTGTGCTGGTGGGCATTGTAATATGCTGGCTACTGTGCATATTGTTTC
CCATCAACGCAAAAATGGCCTGTTTTGATCACAATGTGATGACGAAGTGTACCATGCATGCAGGTGG
GCGTAGAGGAATGTTTATGCCTTACCAGTGTAACATGAATCATGTGAAAGTGTTGTTGGAACCAGATGC
CTTTTCCAGAATGAGCCTAACAGGAATTTTTGACATGAACATGCAAATCTGGAAGATCCTGAGGTATGA
TGATACGAGATCGAGGGTACGCGCATGCGAATGCGGAGGCAAGCATGCCAGGTTCCAGCCGGTGTGTGT
AGATGTGACTGAAGATCTCAGACCGGATCATTTGGTTATTGCCCGCACTGGAGCAGAGTTCGGATCCAG
TGGAGAAGAAACTGACTAAGGTGAGTATTGGGAAAACTTTGGGGTGGGATTTTCAGATGGACAGATTGA
GTAAAAATTTGTTTTTCTGTCTTGCAGCTGTCATGAGTGGAAACGCTTCTTTTAAGGGGGAGTCTTC
AGCCCTTATCTGACAGGGCGTCTCCCATCCTGGGCAGGAGTTCGTCAGAATGTTATGGGATCTACTGTG
GATGGAAGACCCGTCCAACCCGCCAATTCTTCAACGCTGACCTATGCTACTTTAAGTTCTTCACCTTTG
GACGCAGCTGCAGCTGCCGCCGCCGCTTCTGTTGCCGCTAACACTGTGCTTGGAATGGGTTACTATGGA
AGCATCATGGCTAATTCCACTTCCTCTAATAACCCTTCTACCCTGACTCAGGACAAGTTACTTGTCCTT
TTGGCCCAGCTGGAGGCTTTGACCCAACGTCTGGGTGAACTTTCTCAGCAGGTGGTCGAGTTGCGAGTA
CAAACTGAGTCTGCTGTCGGCACGGCAAAGTCTAAATAAAAAAATCCCAGAATCAATGAATAAATAAAC
AAGCTTGTTGTTGATTTAAAATCAAGTGTTTTTATTTCATTTTCGCGCACGGTATGCCCTAGACCACC
GATCTCTATCATTGAGAACTCGGTGGATTTTTCCAGGATCCTATAGAGGTGGGATTGAATGTTTAGAT
ACATGGGCATTAGGCCGTCTTTGGGGTGGAGATAGCTCCATTGAAGGGATTCATGCTCCGGGGTAGTGT
TGTAAATCACCCAGTCATAACAAGGTCGCAGTGCATGGTGTTGCACAATATCTTTTAGAAGTAGGCTGA
TTGCCACAGATAAGCCCTTGGTGTAGGTGTTTACAAACCGGTTGAGCTGGGATGGGTGCATTCGGGGTG
AAATTATGTGCATTTTGGATTGGATTTTAAGTTGGCAATATTGCCGCCAAGATCCCGTCTTGGGTTCA
TGTTATGAAGGACCACCAAGACGGTGTATCCGGTACATTTAGGAAATTTATCGTGCAGCTTGGATGGAA
AAGCGTGGAAAATTTGGAGACACCCTTGTGTCCTCCAAGATTTTCCATGCACTCATCCATGATAATAG
CAATGGGGCCGTGGGCAGCGGCGCGGGCAAACACGTTCCGTGGGTCTGACACATCATAGTTATGTTCCT
GAGTTAAATCATCATAAGCCATTTTAATGAATTTGGGCGGAGAGTACCAGATTGGGGTATGAATGTTC
CTTCGGGCCCCGGAGCATAGTTCCCCTCACAGATTTGCATTTCCCAAGCTTTCAGTTCCGAGGGTGGAA
TCATGTCCACCTGGGGGGCTATGAAAACACCGTTTCTGGGCGGGGGTGATTAATTGTGATGATAGCA
AATTTCTGAGCAATTGAGATTTGCCACATCCGGTGGGGCCATAAATGATTCCGATTACGGGTTGCAGGT
GGTAGTTTAGGGAACGGCAACTGCCGTCTTCTCGAAGCAAGGGGGCCACCTCGTTCATCATTTCCCTTA
CATGCATATTTTCCCGCACCAAATCCATTAGGAGGCGCTCTCCTCCTAGTGATAGAAGTTCTTGTAGTG
AGGAAAAGTTTTTCAGCGGTTTCAGACCGTCAGCCATGGGCATTTTGGAGAGAGTTTGCTGCAAAAGTT
```

Figure 65 continued

```
CTAGTCTGTTCCACAGTTCAGTGATGTGTTCTATGGCATCTCGATCCAGCAGACCTCCTCGTTTCGCGG
GTTTGGACGGCTCCTGGAATAGGGTATGAGACGATGGGCGTCCAGCGCTGCCAGGGTTCGGTCCTTCCA
GGGTCTCAGTGTTCGAGTCAGGGTTGTTTCCGTCACAGTGAAGGGGTGTGCGCCTGCTTGGGCGCTTGC
CAGGGTGCGCTTCAGACTCATCCTGCTGGTCGAAAACTTCTGTCGCTTGGCGCCCTGTATGTCGGCCAA
GTAGCAGTTTACCATGAGTTCGTAGTTGAGCGCCTCGGCTGCGTGGCCTTTGGCGCGGAGCTTACCTTT
GGAAGTTTTCTTGCATACCGGGCAGTATAGGCATTTCAGCGCATACAACTTGGGCGCAAGGAAAACGGA
TTCTGGGGAGTATGCATCTGCGCCGCAGGAGGCGCAAACAGTTTCACATTCCACCAGCCAGGTTAAATC
CGGTTCATTGGGGTCAAAAACAAGTTTTCCGCCATATTTTTGATGCGTTTCTTACCTTTGGTCTCCAT
GAGTTCGTGTCCTCGTTGAGTGACAAACAGGCTGTCCGTGTCCCCGTAGACTGATTTTACAGGCCTCTT
CTCCAGTGGAGTGCCTCGGTCTTCTTCGTACAGGAACTCTGACCACTCTGATACAAAGGCGCGCGTCCA
GGCCAGCACAAAGGAGGCTATGTGGGAGGGGTAGCGATCGTTGTCAACCAGGGGGTCCACCTTTTCCAA
AGTATGCAAACACATGTCACCCTCTTCAACATCCAGGAATGTGATTGGCTTGTAGGTGTATTTCACGTG
ACCTGGGGTCCCCGCTGGGGGGGTATAAAAGGGGGCGGTTCTTTGCTCTTCCTCACTGTCTTCCGGATC
GCTGTCCAGGAACGTCAGCTGTTGGGGTAGGTATTCCCTCTCGAAGGCGGGCATGACCTCTGCACTCAG
GTTGTCAGTTTCTAAGAACGAGGAGGATTTGATATTGACAGTGCCGGTTGAGATGCCTTTCATGAGGTT
TTCGTCCATCTGGTCAGAAAACACAATTTTTTATTGTCAAGTTTGGTGGCAAATGATCCATACAGGGC
GTTGGATAAAGTTTGGCAATGGATCGCATGGTTTGGTTCTTTTCCTTGTCCGCGCGCTCTTTGGCGGC
GATGTTGAGTTGGACATACTCGCGTGCCAGGCACTTCCATTCGGGGAAGATAGTTGTTAATTCATCTGG
CACGATTCTCACTTGCCACCCTCGATTATGCAAGGTAATTAAATCCACACTGGTGGCCACCTCGCCTCG
AAGGGGTTCATTGGTCCAACAGAGCCTACCTCCTTTCCTAGAACAGAAAGGGGGAAGTGGGTCTAGCAT
AAGTTCATCGGGAGGGTCTGCATCCATGGTAAAGATTCCCGGAAGTAAATCCTTATCAAAATAGCTGAT
GGGAGTGGGGTCATCTAAGGCCATTTGCCATTCTCGAGCTGCCAGTGCGCGCTCATATGGGTTAAGGGG
ACTGCCCCATGGCATGGGATGGGTGAGTGCAGAGGCATACATGCCACAGATGTCATAGACGTAGATGGG
ATCCTCAAAGATGCCTATGTAGGTTGGATAGCATCGCCCCCCTCTGATACTTGCTCGCACATAGTCATA
TAGTTCATGTGATGGCGCTAGCAGCCCCGGACCCAAGTTGGTGCGATTGGGTTTTTCTGTTCTGTAGAC
GATCTGGCGAAAGATGGCGTGAGAATTGGAAGAGATGGTGGGTCTTTGAAAAATGTTGAAATGGGCATG
AGGTAGACCTACAGAGTCTCTGACAAAGTGGGCATAAGATTCTTGAAGCTTGGTTACCAGTTCGGCGGT
GACAAGTACGTCTAGGGCGCAGTAGTCAAGTGTTTCTTGAATGATGTCATAACCTGGTTGGTTTTCTT
TTCCCACAGTTCGCGGTTGAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGGCAGCAGCCCTTCTC
TACGGGTAGAGAGTATGCTTGAGCAGCTTTTCGTAGCGAAGCGTGAGTAAGGGCAAAGGTGTCTCTGAC
CATGACTTTGAGGAATTGGTATTTGAAGTCGATGTCGTCACAGGCTCCCTGTTCCCAGAGTTGGAAGTC
TACCCGTTTCTTGTAGGCGGGGTTGGGCAAAGCGAAAGTAACATCATTGAAGAGAATCTTGCCGGCCCT
GGGCATGAAATTGCGAGTGATGCGAAAAGGCTGTGGTACTTCCGCTCGGTTATTGATAACCTGGGCAGC
TAGGACGATCTCGTCGAAACCGTTGATGTTGTGTCCTACGATGTATAATTCTATGAAACGCGGCGTGCC
TCTGACGTGAGGTAGCTTACTGAGCTCATCAAAGGTTAGGTCTGTGGGGTCAGATAAGGCGTAGTGTTC
GAGAGCCCATTCGTGCAGGTGAGGATTCGCTTTAAGGAAGGAGGACCAGAGGTCCACTGCCAGTGCTGT
TTGTAACTGGTCCCGGTACTGACGAAAATGCCGTCCGACTGCCATTTTTCTGGGGTGACGCAATAGAA
GGTTTGGGGTCCTGCCGCCAGCGATCCCACTTGAGTTTTATGGCGAGGTCATAGGCGATGTTGACGAG
CCGCTGGTCTCCAGAGAGTTTCATGACCAGCATGAAGGGGATTAGCTGCTTGCCAAAGGACCCCATCCA
GGTGTAGGTTTCCACATCGTAGGTGAGAAAGAGCCTTTCTGTGCGAGGATGAGAGCCAATCGGGAAGAA
CTGGATCTCCTGCCACCAGTTGGAGGAATGGCTGTTGATGTGATGGAAGTAGAACTCCCTGCGACGCGC
CGAGCATTCATGCTTGTGCTTGTACAGACGGCCGCAGTAGTCGCAGCGTTGCACGGGTTGTATCTCGTG
AATGAGTTGTACCTGGCTTCCCTTGACGAGAAATTTCAGTGGGAAGCCGAGGCCTGGCGATTGTATCTC
GTGCTTTACTATGTTGTCTGCATCGGCCTGTTCATCTTCTGTCTCGATGGTGGTCATGCTGACGAGCCC
TCGCGGGAGGCAAGTCCAGACCTCGGCGCGGCAGGGGCGGAGCTCGAGGACGAGAGCGCGCAGGCTGGA
GCTGTCCAGGGTCCTGAGACGCTGCGGACTCAGGTTAGTAGGCAGTGTCAGGAGATTAACTTGCATGAT
CTTTTGGAGGGCGTGCGGGAGGTTCAGATAGTACTTGATCTCAACGGGTCCGTTGGTGGAGATGTCGAT
GGCTTGCAGGGTTCCGTGTCCCTTGGGCGCTACCACCGTGCCCTTGTTTTTCATTTTGGACGGCGGTGG
CTCTGTTGCTTCTTGCATGTTTAGAAGCGGTGTCGAGGGCGCGCACCGGGCGGCAGGGCGGCTCGGGA
CCCGGCGGCATGGCTGGCAGTGGTACGTCGGCGCCGCGCGGGTAGGTTCTGGTACTGCGCCCTGAGA
AGACTCGCATGCGCGACGACGCGGCGGTTGACATCCTGGATCTGACGCCTCTGGGTGAAAGCTACCGGC
```

Figure 65 continued

```
CCCGTGAGCTTGAACCTGAAAGAGAGTTCAACAGAATCAATCTCGGTATCGTTGACGGCGGCTTGCCTA
AGGATTTCTTGCACGTCACCAGAGTTGTCCTGGTAGGCGATCTCCGCCATGAACTGCTCGATCTCTTCC
TCTTGAAGATCTCCGCGGCCCGCTCTCTCGACGGTGGCCGCGAGGTCGTTGGAGATGCGCCCAATGAGT
TGAGAGAATGCATTCATGCCCGCCTCGTTCCAGACGCGGCTGTAGACCACGGCCCCCACGGGATCTCTC
GCGCGCATGACCACCTGGGCGAGGTTGAGCTCCACGTGGCGGGTGAAGACCGCATAGTTGCATAGGCGC
TGGAAAAGGTAGTTGAGTGTGGTGGCGATGTGCTCGGTGACGAAGAAATACATGATCCATCGTCTCAGC
GGCATCTCGCTGACATCGCCCAGAGCTTCCAAGCGCTCCATGGCCTCGTAGAAGTCCACGGCAAAATTA
AAAAACTGGGAGTTTCGCGCGGACACGGTCAACTCCTCTTCCAGAAGACGGATAAGTTCGGCGATGGTG
GTGCGCACCTCGCGCTCGAAAGCCCCTGGGATTTCTTCCTCAATCTCTTCTTCTTCCACTAACATCTCT
TCCTCTTCAGGTGGGGCTGCAGGAGGAGGGGGAACGCGGCGACGCCGGCGGCGCACGGGCAGACGGTCG
ATGAATCTTTCAATGACCTCTCCGCGGCGGCGGCGCATGGTTTCAGTGACGGCGCGGCCGTTCTCGCGC
GGTCGCAGAGTAAAAACACCGCCGCGCATCTCCTTAAAGTGGTGACTGGGAGGTTCTCCGTTTGGGAGG
GAGAGGGCGCTGATTATACATTTTATTAATTGGCCCGTAGGGACTGCACGCAGAGATCTGATCGTGTCA
AGATCCACGGGATCTGAAAACCTTTCGACGAAAGCGTCTAACCAGTCACAGTCACAAGGTAGGCTGAGT
ACGGCTTCTTGTGGGCGGGGGTGGTTATGTGTTCGGTCTGGGTCTTCTGTTTCTTCTTCATCTCGGGAA
GGTGAGACGATGCTGCTGGTGATGAAATTAAAGTAGGCAGTTCTAAGACGGCGGATGGTGGCGAGGAGC
ACCAGGTCTTTGGGTCCGGCTTGCTGGATACGCAGGCGATTGGCCATTCCCCAAGCATTATCCTGACAT
CTAGCAAGATCTTTGTAGTAGTCTTGCATGAGCCGTTCTACGGGCACTTCTTCCTCACCCGTTCTGCCA
TGCATACGTGTGAGTCCAAATCCGCGCATTGGTTGTACCAGTGCCAAGTCAGCTACGACTCTTTCGGCG
AGGATGGCTTGCTGTACTTGGGTAAGGGTGGCTTGAAAGTCATCAAAATCCACAAAGCGGTGGTAAGCT
CCTGTATTAATGGTGTAAGCACAGTTGGCCATGACTGACCAGTTAACTGTCTGGTGACCAGGGCGCACG
AGCTCGGTGTATTTAAGGCGCGAATAGGCGCGGGTGTCAAAGATGTAATCGTTGCAGGTGCGCACCAGA
TACTGGTACCCTATAAGAAATGCGGCGGTGGTTGGCGGTAGAGAGGCCATCGTTCTGTAGCTGGAGCG
CCAGGGGCGAGGTCTTCCAACATAAGGCGGTGATAGCCGTAGATGTACCTGGACATCCAGGTGATTCCT
GCGGCGGTAGTAGAAGCCCGAGGAAACTCGCGTACGCGGTTCCAAATGTTGCGTAGCGGCATGAAGTAG
TTCATTGTAGGCACGGTTTGACCAGTGAGGCGCGCGCAGTCATTGATGCTCTATAGACACGGAGAAAAT
GAAAGCGTTCAGCGACTCGACTCCGTAGCCTGGAGGAACGTGAACGGGTTGGGTCGCGGTGTACCCCGG
TTCGAGACTTGTACTCGAGCCGGCCGGAGCCGCGGCTAACGTGGTATTGGCACTCCCGTCTCGACCCAG
CCTACAAAAATCCAGGATACGGAATCGAGTCGTTTGCTGGTTTCCGAATGGCAGGGAAGTGAGTCCTA
TTTTTTTTTTTGCCGCTCAGATGCATCCCGTGCTGCGACAGATGCGCCCCAACAACAGCCCCCCTCG
CAGCAGCAGCAGCAGCAATCACAAAAGGCTGTCCCTGCAACTACTGCAACTGCCGCCGTGAGCGGTGCG
GGACAGCCCGCCTATGATCTGGACTTGGAAGAGGGCGAAGGACTGGCACGTCTAGGTGCGCCTTCACCC
GAGCGGCATCCGCGAGTTCAACTGAAAAAGATTCTCGCGAGGCGTATGTGCCCAACAGAACCTATTT
AGAGACAGAAGCGGCGAGGAGCCGGAGGAGATGCGAGCTTCCCGCTTTAACGCGGGTCGTGAGCTGCGT
CACGGTTTGGACCGAAGACGAGTGTTGCGGGACGAGGATTTCGAAGTTGATGAAATGACAGGGATCAGT
CCTGCCAGGGCACACGTGGCTGCAGCCAACCTTGTATCGGCTTACGAGCAGACAGTAAAGGAAGAGCGT
AACTTCCAAAAGTCTTTTAATAATCATGTGCGAACCCTGATTGCCCGCGAAGAAGTTACCCTTGGTTTG
ATGCATTTGTGGGATTTGATGGAAGCTATCATTCAGAACCCTACTAGCAAACCTCTGACCGCCCAGCTG
TTTCTGGTGGTGCAACACAGCAGAGACAATGAGGCTTTCAGAGAGGCGCTGCTGAACATCACCGAACCC
GAGGGGAGATGGTTGTATGATCTTATCAACATTCTACAGAGTATCATAGTGCAGGAGCGGAGCCTGGGC
CTGGCCGAGAAGGTGGCTGCCATCAATTACTCGGTTTTGAGCTTGGGAAAATATTACGCTCGCAAAATC
TACAAGACTCCATACGTTCCCATAGACAAGGAGGTGAAGATAGATGGGTTCTACATGCGCATGACGCTC
AAGGTCTTGACCCTGAGCGATGATCTTGGGGTGTATCGCAATGACAGAATGCATCGCGCGGTTAGCGCC
AGCAGGAGGCGCGAGTTAAGCGACAGGGAACTGATGCACAGTTTGCAAAGAGCTCTGACTGGAGCTGGA
ACCGAGGGTGAGAATTACTTCGACATGGGAGCTGACTTGCAGTGGCAGCCTAGTCGCAGGGCTCTGAGC
GCCGCGACGGCAGGATGTGAGCTTCCTTACATAGAAGAGGCGGATGAAGGCGAGGAGGAAGAGGGCGAG
TACTTGGAAGACTGATGGCACAACCCGTGTTTTTGCTAGATGGAACAGCAAGCACCGGATCCCGCAAT
GCGGGCGGCGCTGCAGAGCCAGCCGTCCGGCATTAACTCCTCGGACGATTGGACCCAGGCCATGCAACG
TATCATGGCGTTGACGACTCGCAACCCCGAAGCCTTTAGACAGCAACCCCAGGCCAACCGTCTATCGGC
CATCATGGAAGCTGTAGTGCCTTCCCGCTCTAATCCCACTCATGAGAAGGTCCTGGCCATCGTGAACGC
GTTGGTGGAGAACAAAGCTATTCGTCCAGATGAGGCCGGACTGGTATACAACGCTCTCTTAGAACGCGT
GGCTCGCTACAACAGTAGCAATGTGCAAACCAATTTGGACCGTATGATAACAGATGTACGCGAAGCCGT
```

Figure 65 continued

```
GTCTCAGCGCGAAAGGTTCCAGCGTGATGCCAACCTGGGTTCGCTGGTGGCGTTAAATGCTTTCTTGAG
TACTCAGCCTGCTAATGTGCCGCGTGGTCAACAGGATTATACTAACTTTTTAAGTGCTTTGAGACTGAT
GGTATCAGAAGTACCTCAGAGCGAAGTGTATCAGTCCGGTCCTGATTACTTCTTTCAGACTAGCAGACA
GGGCTTGCAGACGGTAAATCTGAGCCAAGCTTTTAAAAACCTTAAAGGTTTGTGGGGAGTGCATGCCCC
GGTAGGAGAAAGAGCAACCGTGTCTAGCTTGTTAACTCCGAACTCCCGCCTATTATTACTGTTGGTAGC
TCCTTTCACCGACAGCGGTAGCATCGACCGTAATTCCTATTTGGGTTACCTACTAAACCTGTATCGCGA
AGCCATAGGGCAAAGTCAGGTGGACGAGCAGACCTATCAAGAAATTACCCAAGTCAGTCGCGCTTTGGG
ACAGGAAGACACTGGCAGTTTGGAAGCCACTCTGAACTTCTTGCTTACCAATCGGTCTCAAAAGATCCC
TCCTCAATATGCTCTTACTGCGGAGGAGGAGAGGATCCTTAGATATGTGCAGCAGAGCGTGGGATTGTT
TCTGATGCAAGAGGGGCAACTCCGACTGCAGCACTGGACATGACAGCGCGAAATATGGAGCCCAGCAT
GTATGCCAGTAACCGACCTTTCATTAACAAACTGCTGGACTACTTGCACAGAGCTGCCGCTATGAACTC
TGATTATTTCACCAATGCCATCTTAAACCCGCACTGGCTGCCCCACCTGGTTTCTACACGGGCGAATA
TGACATGCCCGACCCTAATGACGGATTTCTGTGGGACGACGTGGACAGCGATGTTTTTCACCTCTTTC
TGATCATCGCACGTGGAAAAAGGAAGGCGGCGATAGAATGCATTCTTCTGCATCGCTGTCCGGGGTCAT
GGGTGCTACCGCGGCTGAGCCCGAGTCTGCAAGTCCTTTTCCTAGTCTACCCTTTTCTCTACACAGTGT
ACGTAGCAGCGAAGTGGGTAGAATAAGTCGCCCGAGTTTAATGGGCGAAGAGGAGTATCTAAACGATTC
CTTGCTCAGACCGGCAAGAGAAAAAAATTTCCCAAACAATGGAATAGAAAGTTTGGTGGATAAAATGAG
TAGATGGAAGACTTATGCTCAGGATCACAGAGACGAGCCTGGGATCATGGGGATTACAAGTAGAGCGAG
CCGTAGACGCCAGCGCCATGACAGACAGAGGGGTCTTGTGTGGGACGATGAGGATTCGGCCGATGATAG
CAGCGTGCTGGACTTGGGTGGGAGAGGAAGGGGCAACCCGTTTGCTCATTTGCGCCCTCGCTTGGGTGG
TATGTTGTAAAAAAAAATAAAAAAAAAACTCACCAAGGCCATGGCGACGAGCGTACGTTCGTTCTTCTT
TATTATCTGTGTCTAGTATAATGAGGCGAGTCGTGCTAGGCGGAGCGGTGGTGTATCCGGAGGGTCCTC
CTCCTTCGTACGAGAGCGTGATGCAGCAGCAGCAGGCGACGGCGGTGATGCAATCCCCACTGGAGGCTC
CCTTTGTGCCTCCGCGATACCTGGCACCTACGGAGGGCAGAAACAGCATTCGTTATTCGGAACTGGCAC
CTCAGTACGATACCACCAGGTTGTATCTGGTGGACAACAAGTCGGCGGACATTGCTTCTCTGAACTATC
AGAATGACCACAGCAACTTCTTGACCACGGTGGTGCAAAACAATGACTTTACCCCTACGGAAGCCAGCA
CCCAGACCATTAACTTTGATGAACGATCGCGGTGGGCGGTCAGCTAAAGACCATCATGCATACTAACA
TGCCAAACGTGAACGAGTATATGTTTAGTAACAAGTTCAAAGCGCGTGTGATGGTGTCCAGAAAACCTC
CCGACGGTGCTGCAGTTGGGGATACTTATGATCACAAGCAGGATATTTTGAAATATGAGTGGTTCGAGT
TTACTTTGCCAGAAGGCAACTTTTCAGTTACTATGACTATTGATTTGATGAACAATGCCATCATAGATA
ATTACTTGAAAGTGGGTAGACAGAATGGAGTGCTTGAAAGTGACATTGGTGTTAAGTTCGACACCAGGA
ACTTCAAGCTGGGATGGGATCCCGAAACCAAGTTGATCATGCCTGGAGTGTATACGTATGAAGCCTTCC
ATCCTGACATTGTCTTACTGCCTGGCTGCGGAGTGGATTTTACCGAGAGTCGTTTGAGCAACCTTCTTG
GTATCAGAAAAAAACAGCCATTTCAAGAGGGTTTTAAGATTTTGTATGAAGATTTAGAAGGTGGTAATA
TTCCGGCCCTCTTGGATGTAGATGCCTATGAGAACAGTAAGAAAGAACAAAAAGCCAAAATAGAAGCTG
CTACAGCTGCTGCAGAAGCTAAGGCAAACATAGTTGCCAGCGACTCTACAAGGGTTGCTAACGCTGGAG
AGGTCAGAGGAGACAATTTTGCGCCAACACCTGTTCCGACTGCAGAATCATTATTGGCCGATGTGTCTG
AAGGAACGGACGTGAAACTCACTATTCAACCTGTAGAAAAGATAGTAAGAATAGAAGCTATAATGTGT
TGGAAGACAAAATCAACACAGCCTATCGCAGTTGGTATCTTTCGTACAATTATGGCGATCCCGAAAAAG
GAGTGCGTTCCTGGACATTGCTCACCACCTCAGATGTCACCTGCGGAGCAGAGCAGGTCTACTGGTCGC
TTCCAGACATGATGAAGGATCCTGTCACTTTCCGCTCCACTAGACAAGTCAGTAACTACCCTGTGGTGG
GTGCAGAGCTTATGCCCGTCTTCTCAAAGAGCTTCTACAACGAACAAGCTGTGTACTCCCAGCAGCTCC
GCCAGTCCACCTCGCTTACGCACGTCTTCAACCGCTTTCCTGAGAACCAGATTTTAATCCGTCCGCCGG
CGCCCACCATTACCACCGTCAGTGAAAACGTTCCTGCTCTCACAGATCACGGGACCCTGCCGTTGCGCA
GCAGTATCCGGGGAGTCCAACGTGTGACCGTTACTGACGCCAGACGCCGCACCTGTCCCTACGTGTACA
AGGCACTGGGCATAGTCGCACCGCGCGTCCTTTCAAGCCGCACTTTCTAAAAAAAAAAAAAATGTCCAT
TCTTATCTCGCCCAGTAATAACACCGGTTGGGGTCTGCGCGCTCCAAGCAAGATGTACGGAGGCGCACG
CAAACGTTCTACCCAACATCCTGTCCGTGTTCGCGGACATTTTCGCGCTCCATGGGCGCCCTCAAGGG
CCGCACTCGCGTTCGAACCACCGTCGATGATGTAATCGATCAGGTGGTTGCCGACGCCCGTAATTATAC
TCCTACTGCGCCTACATCTACTGTGGATGCAGTTATTGACAGTGTAGTGGCTGACGCTCGCAACTATGC
TCGACGTAAGAGCCGGCGAAGGCGCATTGCCAGACGCCACCGAGCTACCACTGCCATGCGAGCCGCAAG
AGCTCTGCTACGAAGAGCTAGACGCGTGGGGCGAAGAGCCATGCTTAGGGCGGCCAGACGTGCAGCTTC
```

Figure 65 continued

```
GGGCGCCAGCGCCGGCAGGTCCCGCAGGCAAGCAGCCGCTGTCGCAGCGGCGACTATTGCCGACATGGC
CCAATCGCGAAGAGGCAATGTATACTGGGTGCGTGACGCTGCCACCGGTCAACGTGTACCCGTGCGCAC
CCGTCCCCCTCGCACTTAGAAGATACTGAGCAGTCTCCGATGTTGTGTCCCAGCGGCGAGGATGTCCAA
GCGCAAATACAAGGAAGAAATGCTGCAGGTTATCGCACCTGAAGTCTACGGCCAACCGTTGAAGGATGA
AAAAAACCCCGCAAATCAAGCGGGTTAAAAAGGACAAAAAAGAAGAGGAAGATGGCGATGATGGGCT
GGCGGAGTTTGTGCGCGAGTTTGCCCCACGGCGACGCGTGCAATGGCGTGGGCGCAAAGTTCGACATGT
GTTGAGACCTGGAACTTCGGTGGTCTTTACACCCGGCGAGCGTTCAAGCGCTACTTTTAAGCGTTCCTA
TGATGAGGTGTACGGGGATGATGATATTCTTGAGCAGGCGGCTGACCGATTAGGCGAGTTTGCTTATGG
CAAGCGTAGTAGAATAACTTCCAAGGATGAGACAGTGTCGATACCCTTGGATCATGGAAATCCACCCC
TAGTCTTAAACCGGTCACTTTGCAGCAAGTGTTACCCGTAACTCCGCGAACAGGTGTTAAACGCGAAGG
TGAAGATTTGTATCCCACTATGCAACTGATGGTACCCAAACGCCAGAAGTTGGAGGACGTTTTGGAGAA
AGTAAAGTGGATCCAGATATTCAACCTGAGGTTAAAGTGAGACCCATTAAGCAGGTAGCGCCTGGTCT
GGGGGTACAAACTGTAGACATTAAGATTCCCACTGAAAGTATGGAAGTGCAAACTGAACCCGCAAAGCC
TACTGCCACCTCCACTGAAGTGCAAACGGATCCATGGATGCCCATGCCTATTACAACTGACGCCGCCGG
TCCCACTCGAAGATCCCGACGAAAGTACGGTCCAGCAAGTCTGTTGATGCCCAATTATGTTGTACACCC
ATCTATTATTCCTACTCCTGGTTACCGAGGCACTCGCTACTATCGCAGCCGAAACAGTACCTCCCGCCG
TCGCCGCAAGACACCTGCAAATCGCAGTCGTCGCCGTAGACGCACAAGCAAACCGACTCCCGGCGCCCT
GGTGCGGCAAGTGTACCGCAATGGTAGTGCGGAACCTTTGACACTGCCGCGTGCGCGTTACCATCCGAG
TATCATCACTTAATCAATGTTGCCGCTGCCTCCTTGCAGATATGGCCCTCACTTGTCGCCTTCGCGTTC
CCATCACTGGTTACCGAGGAAGAAACTCGCGCCGTAGAAGAGGGATGTTGGGACGCGGAATGCGACGCT
ACAGGCGACGGCGTGCTATCCGCAAGCAATTGCGGGGTGGTTTTTTACCAGCCTTAATTCCAATTATCG
CTGCTGCAATTGGCGCGATACCAGGCATAGCTTCCGTGGCGGTTCAGGCCTCGCAACGACATTGACATT
GGAAAAAAACGTATAAATAAAAAAAAAAAATACAATGGACTCTGACACTCCTGGTCCTGTGACTATGT
TTTCTTAGAGATGGAAGACATCAATTTTTCATCCTTGGCTCCGCGACACGGCACGAAGCCGTACATGGG
CACCTGGAGCGACATCGGCACGAGCCAACTGAACGGGGGCGCCTTCAATTGGAGCAGTATCTGGAGCGG
GCTTAAAAATTTTGGCTCAACCATAAAAACATACGGGAACAAAGCTTGGAACAGCAGTACAGGACAGGC
GCTTAGAAATAAACTTAAAGACCAGAACTTCCAACAAAAAGTAGTCGATGGGATAGCTTCCGGCATCAA
TGGAGTGGTAGATTTGGCTAACCAGGCTGTGCAGAAAAAGATAAACAGTCGTTTGGACCCGCCGCCAGC
AACCCCAGGTGAAATGCAAGTGGAGGAAGAAATTCCTCCGCCAGAAAAACGAGGCGACAAGCGTCCGCG
TCCCGATTTGGAAGAGACGCTGGTGACGCGCGTAGATGAACCGCCTTCTTATGAGGAAGCAACGAAGCT
TGGAATGCCCACCACTAGACCGATAGCCCCAATGGCCACCGGGGTGATGAAACCTTCTCAGTTGCATCG
ACCCGTCACCTTGGATTTGCCCCCTCCCCCTGCTGCTACTGCTGTACCCGCTTCTAAGCCTGTCGCTGC
CCCGAAACCAGTCGCCGTAGCCAGGTCACGTCCCGGGGGCGCTCCTCGTCCAAATGCGCACTGGCAAAA
TACTCTGAACAGCATCGTGGGTCTAGGCGTGCAAAGTGTAAAACGCCGTCGCTGCTTTTAATTAAATAT
GGAGTAGCGCTTAACTTGCCTATCTGTGTATATGTGTCATTACACGCCGTCACAGCAGCAGAGGAAAAA
AGGAAGAGGTCGTGCGTCGACGCTGAGTTACTTTCAAGATGGCCACCCCATCGATGCTGCCCCAATGGG
CATACATGCACATCGCCGGACAGGATGCTTCGGAGTACCTGAGTCCGGGTCTGGTGCAGTTCGCCCGCG
CCACAGACACCTACTTCAATCTGGGAAATAAGTTTAGAAATCCCACCGTAGCGCCGACCCACGATGTGA
CCACCGACCGTAGCCAGCGGCTCATGTTGCGCTTCGTGCCCGTTGACCGGGAGGACAATACATACTCTT
ACAAAGTGCGGTACACCCTGGCCGTGGGCGACAACAGAGTGCTGGATATGGCCAGCACGTTCTTTGACA
TTAGGGGTGTGTTGGACAGAGGTCCCAGTTTCAAACCCTATTCTGGTACGGCTTACAACTCCCTGGCTC
CTAAAGGCGCTCCAAATACATCTCAGTGGATTGCAGAAGGTGTAAAAAATACAACTGGTGAGGAACACG
TAACAGAAGAGGAAACCAATACTACTACTTACACTTTTGGCAATGCTCCTGTAAAAGCTGAAGCTGAAA
TTACAAAAGAAGGACTCCCAGTAGGTTTGGAAGTTTCAGATGAAGAAAGTAAACCGATTTATGCTGATA
AACATATCAGCCAGAACCTCAGCTGGGAGATGAAACTTGGACTGACCTTGATGGAAAAACCGAAAAGT
ATGGAGGCAGGGCTCTCAAACCCGATACTAAGATGAAACCATGCTACGGGTCCTTTGCCAAACCTACTA
ATGTGAAAGGCGGTCAGGCAAAACAAAAAACAACGGAGCAGCCAAATCAGAAAGTCGAATATGATATCG
ACATGGAGTTTTTTGATGCGGCATCGCAGAAAACAAACTTAAGTCCTAAAATTGTCATGTATGCAGAAA
ATGTAAATTTGGAAACTCCAGACACTCATGTAGTGTACAAACCTGGAACAGAAGACACAAGTTCCGAAG
CTAATTTGGGACAACAATCTATGCCCAACAGACCCAACTACATTGGCTTCAGAGATAACTTTATTGGAC
TTATGTACTATAACAGTACTGGTAACATGGGGGTGCTGGCTGGTCAAGCGTCTCAGTTAAATGCAGTGG
TTGACTTGCAGGACAGAAACACAGAACTTTCTTACCAACTCTTGCTTGACTCTCTGGGCGACAGAACCA
```

Figure 65 continued

```
GATACTTTAGCATGTGGAATCAGGCTGTGGACAGTTATGATCCTGATGTACGTGTTATTGAAAATCATG
GTGTGGAAGATGAACTTCCCAACTACTGTTTTCCACTGGACGGCATAGGTGTTCCAACAACCAGTTACA
AATCAATAGTTCCAAATGGAGACAATGCGCCTAATTGGAAGGAACCTGAAGTAAATGGAACAAGTGAGA
TCGGACAGGGTAATTTGTTTGCCATGGAAATTAACCTTCAAGCCAATCTATGGCGAAGTTTCCTTTATT
CCAATGTGGCTCTATATCTCCCAGACTCGTACAAATACACCCGTCCAATGTCACTCTTCCAGAAAACA
AAAACACCTACGACTACATGAACGGGCGGGTGGTGCCGCCATCTCTAGTAGACACCTATGTGAACATTG
GTGCCAGGTGGTCTCTGGATGCCATGGACAATGTCAACCCATTCAACCACCACCGTAACGCTGGCTTGC
GTTACCGATCCATGCTTCTGGGTAACGGACGTTATGTGCCTTTCCACATACAAGTGCCTCAAAAATTCT
TCGCTGTTAAAAACCTGCTGCTTCTCCCAGGCTCCTACACTTATGAGTGGAACTTTAGGAAGGATGTGA
ACATGGTTCTACAGAGTTCCCTCGGTAACGACCTGCGGGTAGATGGCGCCAGCATCAGTTTCACGAGCA
TCAACCTCTATGCTACTTTTTTCCCCATGGCTCACAACACCGCTTCCACCCTTGAAGCCATGCTGCGGA
ATGACACCAATGATCAGTCATTCAACGACTACCTATCTGCAGCTAACATGCTCTACCCCATTCCTGCCA
ATGCAACCAATATTCCCATTTCCATTCCTTCTCGCAACTGGGCGGCTTTCAGAGGCTGGTCATTTACCA
GACTGAAAACCAAGAAACTCCCTCTTTGGGGTCTGGATTTGACCCCTACTTTGTCTATTCTGGTTCTA
TTCCCTACCTGGATGGTACCTTCTACCTGAACCACACTTTTAAGAAGGTTTCCATCATGTTTGACTCTT
CAGTGAGCTGGCCTGGAAATGACAGGTTACTATCTCCTAACGAATTTGAAATAAAGCGCACTGTGGATG
GCGAAGGCTACAACGTAGCCCAATGCAACATGACCAAAGACTGGTTCTTGGTACAGATGCTCGCCAACT
ACAACATCGGCTATCAGGGCTTCTACATTCCAGAAGGATACAAAGATCGCATGTATTCATTTTTCAGAA
ACTTCCAGCCCATGAGCAGGCAGGTGGTTGATGAGGTCAATTACAAAGACTTCAAGGCCGTCGCCATAC
CCTACCAACACAACAACTCTGGCTTTGTGGGTTACATGGCTCCGACCATGCGCCAAGGTCAACCCTATC
CCGCTAACTATCCCTATCCACTCATTGGAACAACTGCCGTAAATAGTGTTACGCAGAAAAAGTTCTTGT
GTGACAGAACCATGTGGCGCATACCGTTCTCGAGCAACTTCATGTCTATGGGGGCCCTTACAGACTTGG
GACAGAATATGCTCTATGCCAACTCAGCTCATGCTCTGGACATGACCTTTGAGGTGGATCCCATGGATG
AGCCCACCCTGCTTTATCTTCTTCGAAGTTTTCGACGTGGTCAGAGTGCATCAGCCACACCGCGGCA
TCATCGAGGCAGTCTACCTGCGTACACCGTTCTCGGCCGGTAACGCTACCACGTAAGAAGCTTCTTGCT
TCTTGCAAATAGCAGCTGCAACCATGGCCTGCGGATCCCAAAACGGCTCCAGCGAGCAAGAGCTCAGAG
CCATTGTCCAAGACCTGGGTTGCGGACCCTATTTTTGGGAACCTACGATAAGCGCTTCCCGGGGTTCA
TGGCCCCCGATAAGCTCGCCTGTGCCATTGTAAATACGGCCGGACGTGAGACGGGGGGAGAGCACTGGT
TGGCTTTCGGTTGGAACCCACGTTCTAACACCTGCTACCTTTTGATCCTTTTGGATTCTCGGATGATC
GTCTCAAACAGATTTACCAGTTTGAATATGAGGGTCTCCTGCGCCGCAGCGCTCTTGCTACCAAGGACC
GCTGTATTACGCTGGAAAAATCTACCCAGACCGTGCAGGGTCCCCGTTCTGCCGCCTGCGGACTTTTCT
GCTGCATGTTCCTTCACGCCTTTGTGCACTGGCCTGACCGTCCCATGGACGGAAACCCCACCATGAAAT
TGCTAACTGGAGTGCCAAACAACATGCTTCATTCTCCTAAAGTCCAGCCCACCCTGTGTGACAATCAAA
AAGCACTCTACCATTTTCTTAATACCCATTCGCCTTATTTCGCTCCCATCGTACACACATCGAAAGGG
CCACTGCGTTCGACCGTATGGATGTTCAATAATGACTCATGTAAACAACGTGTTCAATAAACATCACTT
TATTTTTTACATGTATCAAGGCTCTGCATTACTTATTTATTTACAAGTCGAATGGGTTCTGACGAGAA
TCAGAATGACCCGCAGGCAGTGATACGTTGCGGAACTGATACTTGGGTTGCCACTTGAATTCGGGAATC
ACCAACTTGGGAACCGGTATATCGGGCAGGATGTCACTCCACAGCTTTCTGGTCAGCTGCAAAGCTCCA
AGCAGGTCAGGAGCCGAAATCTTGAAATCACAATTAGGACCAGTGCTTTGAGCGCGAGAGTTGCGGTAC
ACCGGATTGCAGCACTGAAACACCATCAGCGACGGATGTCTCACGCTTGCCAGCACGGTGGGATCTGCA
ATCATGCCCACATCCAGATCTTCAGCATTGGCAATGCTGAACGGGGTCATCTTGCAGGTCTGCCTACCC
ATGGCGGGCACCCAATTAGGCTTGTGGTTGCAATCGCAGTGCAGGGGATCAGTATCATCTTGGCCTGA
TCCTGTCTGATTCCTGGATACACGGCTCTCATGAAGCATCATATTGCTTGAAAGCCTGCTGGGCTTTA
CTACCCTCGGTATAAAACATCCCGCAGGACCTGCTCGAAAACTGGTTAGCTGCACAGCCGGCATCATTC
ACACAGCAGCGGGCGTCATTGTTAGCTATTTGCACCACACTTCTGCCCCAGCGGTTTTGGGTGATTTTG
GTTCGCTCGGGATTCTCCTTTAAGGCTCGTTGTCCGTTCTCGCTGGCCACATCCATCTCGATAATCTGC
TCCTTCTGAATCATAATATTGCCATGCAGGCACTTCAGCTTGCCCTCATAATCATTGCAGCCATGAGGC
CACAACGCACAGCCTGTACATTCCCAATTATGGTGGGCGATCTGAGAAAAGAATGTATCATTCCCTGC
AGAAATCTTCCCATCATCGTGCTCAGTGTCTTGTGACTAGTGAAAGTTAACTGGATGCCTCGGTGCTCC
TCGTTTACGTACTGGTGACAGATGCGCTTGTATTGTTCGTGTTGCTCAGGCATTAGTTTAAAAGAGGTT
CTAAGTTCGTTATCCAGCCTGTACTTCTCCATCAGCAGACACATCACTTCCATGCCTTTCTCCCAAGCA
GACACCAGGGGCAAGCTAATCGGATTCTTAACAGTGCAGGCAGCAGCTCCTTTAGCCAGAGGGTCATCT
```

Figure 65 continued

```
TTAGCGATCTTCTCAATGCTTCTTTTGCCATCCTTCTCAACGATGCGCACGGGCGGGTAGCTGAAACCC
ACTGCTACAAGTTGCGCCTCTTCTCTTTCTTCTTCGCTGTCTTGACTGATGTCTTGCATGGGGATATGT
TTGGTCTTCCTTGGCTTCTTTTGGGGGGTATCGGAGGAGGAGGACTGTCGCTCCGTTCCGGAGACAGG
GAGGATTGTGACGTTTCGCTCACCATTACCAACTGACTGTCGGTAGAAGAACCTGACCCCACACGGCGA
CAGGTGTTTCTCTTCGGGGGCAGAGGTGGAGGCGATTGCGAAGGGCTGCGGTCCGACCTGGAAGGCGGA
TGACTGGCAGAACCCCTTCCGCGTTCGGGGGTGTGCTCCCTGTGGCGGTCGCTTAACTGATTTCCTTCG
CGGCTGGCCATTGTGTTCTCCTAGGCAGAGAAACAACAGACATGGAAACTCAGCCATTGCTGTCAACAT
CGCCACGAGTGCCATCACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATGACATGCAGAATAAAA
AAGCGAAAGAGTCTGAGACAGACATCGAGCAAGACCCGGGCTATGTGACACCGGTGGAACACGAGGAAG
AGTTGAAACGCTTTCTAGAGAGAGAGGATGAAAACTGCCCAAAACAACGAGCAGATAACTATCACCAAG
ATGCTGGAAATAGGGATCAGAACACCGACTACCTCATAGGGCTTGACGGGAAGACGCGCTCCTTAAAC
ATCTAGCAAGACAGTCGCTCATAGTCAAGGATGCATTATTGGACAGAACTGAAGTGCCCATCAGTGTGG
AAGAGCTCAGCCGCGCCTACGAGCTTAACCTCTTTTCACCTCGTACTCCCCCCAAACGTCAGCCAAACG
GCACCTGCGAGCCAAATCCTCGCTTAAACTTTTATCCAGCTTTTGCTGTGCCAGAAGTACTGGCTACCT
ATCACATCTTTTTTAAAAATCAAAAAATTCCAGTCTCCTGCCGCGCTAATCGCACCCGCGCCGATGCCC
TACTCAATCTGGGACCTGGTTCACGCTTACCTGATATAGCTTCCTTGGAAGAGGTTCCAAAGATCTTCG
AGGGTCTGGGCAATAATGAGACTCGGGCCGCAAATGCTCTGCAAAAGGGAGAAAATGGCATGGATGAGC
ATCACAGCGTTCTGGTGGAATTGGAAGGCGATAATGCCAGACTCGCAGTACTCAAGCGAAGCATCGAGG
TCACACACTTCGCATATCCCGCTGTCAACCTGCCCCCTAAAGTCATGACGGCGGTCATGGACCAGTTAC
TCATTAAGCGCGCAAGTCCCCTTTCAGAAGACATGCATGACCCAGATGCCTGTGATGAGGGTAAACCAG
TGGTCAGTGATGAGCAGCTAACCCGATGGCTGGGCACCGACTCTCCCAGGGATTTGGAAGAGCGTCGCA
AGCTTATGATGGCCGTGGTGCTGGTTACCGTAGAACTAGAGTGTCTCCGACGTTTCTTTACCGATTCAG
AAACCTTGCGCAAACTCGAAGAGAATCTGCACTACACTTTTAGACACGGCTTTGTGCGGCAGGCATGCA
AGATATCTAACGTGGAACTCACCAACCTGGTTTCCTACATGGGTATTCTGCATGAGAATCGCCTAGGAC
AAAGCGTGCTGCACAGCACCCTGAAGGGGGAAGCCCGCCGTGATTACATCCGCGATTGTGTCTATCTGT
ACCTGTGCCACACGTGGCAAACCGGCATGGGTGTATGGCAGCAATGTTTAGAAGAACAGAACTTGAAAG
AGCTTGACAAGCTCTTACAGAAATCTCTTAAGGTTCTGTGGACAGGGTTCGACGAGCGCACCGTCGCTT
CCGACCTGGCAGACCTCATCTTCCCAGAGCGTCTCAGGGTTACTTTGCGAAACGGATTGCCTGACTTTA
TGAGCCAGAGCATGCTTAACAATTTTCGCTCTTTCATCCTGGAACGCTCCGGTATCCTGCCCGCCACCT
GCTGCGCACTGCCCTCCGACTTTGTGCCTCTCACCTACCGCGAGTGCCCCCCGCCGCTATGGAGTCACT
GCTACCTGTTCCGTCTGGCCAACTATCTCTCCTACCACTCGGATGTGATCGAGGATGTGAGCGGAGACG
GCTTGCTGGAGTGTCACTGCCGCTGCAATCTGTGCACGCCCCACCGGTCCCTAGCTTGCAACCCCCAGT
TGATGAGCGAAACCCAGATAATAGGCACCTTTGAATTGCAAGGCCCCAGCAGCCAAGGCGATGGGTCTT
CTCCTGGGCAAAGTTTAAAACTGACCCCGGGACTGTGGACCTCCGCCTACTTGCGCAAGTTTGCTCCGG
AAGATTACCACCCCTATGAAATCAAGTTCTATGAGGACCAATCACAGCCTCCAAAGGCCGAACTTTCGG
CCTGCGTCATCACCCAGGGGGCAATTCTGGCCCAATTGCAAGCCATCCAAAAATCCCGCCAAGAATTTC
TACTGAAAAAGGGTAAGGGGGTCTACCTTGACCCCCAGACCGGCGAGGAACTCAACACAAGGTTCCCTC
AGGATGTCCCAACGACGAGAAAACAAGAAGTTGAAGGTGCAGCCGCCGCCCCAGAAGATATGGAGGAA
GATTGGGACAGTCAGGCAGAGGAGGCGGAGGAGGACAGTCTGGAGGACAGTCTGGAGGAAGACAGTTTG
GAGGAGGAAAACGAGGAGGCAGAGGAGGTGGAAGAAGTAACCGCCGACAAACAGTTATCCTCGGCTGCG
GAGACAAGCAACAGCGCTACCATCTCCGCTCCGAGTCGAGGAACCCGGCGGCGTCCCAGCAGTAGATGG
GACGAGACCGGACGCTTCCCGAACCCAACCAGCGCTTCCAAGACCGGTAAGAAGGATCGGCAGGGATAC
AAGTCCTGGCGGGGGCATAAGAATGCCATCATCTCCTGCTTGCATGAGTGCGGGGGCAACATATCCTTC
ACGCGGCGCTACTTGCTATTCCACCATGGGTGAACTTTCCGCGCAATGTTTTGCATTACTACCGTCAC
CTCCACAGCCCCTACTATAGCCAGCAAATCCCGGCAGTCTCGACAGATAAAGACAGCGGCGGCGACCTC
CAACAGAAACCAGCAGCGGCAGTTAGAAAATACACAACAAGTGCAGCAACAGGAGGATTAAAGATTAC
AGCCAACGAGCCAGCGCAAACCCGAGAGTTAAGAAATCGGATCTTTCCAACCCTGTATGCCATCTTCCA
GCAGAGTCGGGGTCAAGAGCAGGAACTGAAAATAAAAAACCGATCTCTGCGTTCGCTCACCAGAAGTTG
TTTGTATCACAAGAGCGAAGATCAACTTCAGCGCACTCTCGAGGACGCCGAGGCTCTCTTCAACAAGTA
CTGCGCGCTGACTCTTAAAGAGTAGGCAGCGACCGCGCTTATTCAAAAAGGCGGGAATTACATCATCC
TCGACATGAGTAAAGAAATTCCCACGCCTTACATGTGGAGTTATCAACCCCAAATGGGATTGGCGGCAG
```

Figure 65 continued

```
GCGCCTCCCAGGACTACTCCACCCGCATGAATTGGCTCAGCGCCGGGCCTTCTATGATTTCTCGAGTTA
ATGATATACGCGCCTACCGAAACCAAATACTTTTGGAACAGTCAGCTCTTACCACCACGCCCCGCCAAC
ACCTTAATCCCAGAAATTGGCCCGCCGCCCTAGTGTACCAGGAAAGTCCCGCTCCCACCACTGTATTAC
TTCCTCGAGACGCCCAGGCCGAAGTCCAAATGACTAATGCAGGTGCGCAGTTAGCTGGCGGCTCCACCC
TATGTCGTCACAGGCCTCGGCATAATATAAAACGCCTGATGATCAGAGGCCGAGGTATCCAGCTCAACG
ACGAGTCGGTGAGCTCTCCGCTTGGTCTACGACCAGACGGAATCTTTCAGATTGCCGGCTGCGGGAGAT
CTTCCTTCACCCCTCGTCAGGCTGTTCTGACTTTGGAAAGTTCGTCTTCGCAACCCCGCTCGGGCGGAA
TCGGGACCGTTCAATTTGTGGAGGAGTTTACTCCCTCTGTCTACTTCAACCCCTTCTCCGGATCTCCTG
GGCATTACCCGGACGAGTTCATACCGAACTTCGACGCGATTAGCGAGTCAGTGGACGGCTACGATTGAT
GTCTGGTGACGCGGCTGAGCTATCTCGGCTGCGACATCTAGACCACTGCCGCCGCTTTCGCTGCTTTGC
CCGGGAACTCATTGAGTTCATCTACTTCGAACTCCCCAAGGATCACCCTCAAGGTCCGGCCCACGGAGT
GCGGATTTCTATCGAAGGCAAAATAGACTCTCGCCTGCAACGAATTTTCTCCCAGCGGCCCGTGCTGAT
CGAGCGAGACCAGGGAAACACCACGGTTTCCATCTACTGCATTTGTAATCACCCCGGATTGCATGAAAG
CCTTTGCTGTCTTATGTGTACTGAGTTTAATAAAAACTGAATTAAGACTCTCCTACGGACTGCCGCTTC
TTCAACCCGGATTTTACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTTCCCTACTAATACTA
CTTTCAAAACCGGAGGTGAGCTCCAAGGTCTTCCTACAGAAAACCCTTGGGTGGAAGCGGGCCTTGTAG
TGCTAGGAATTCTTGCGGGTGGGCTTGTGATTATTCTTTGCTACCTATACACACCTTGCTTCACTTTCT
TAGTGGTGTTGTGGTATTGGTTTAAAAAATGGGGCCCATACTAGTCTTGCTTGTTTTACTTTCGCTTTT
GGAACCGGGTTCTGCCAATTACGATCCATGTCTAGACTTCGACCCAGAAAACTGCACACTTACTTTTGC
ACCCGACACAAGCCGCATCTGTGGAGTTCATCGCCTCTTACGAACTTGGCCCCAACGACAAAAATT
TACCTGCATGGTGGGAATCAACCCCATAGTTATCACCCAGCAAAGTGGAGATACTAAGGGTTGCATTCA
CTGCTCCTGCGATTCCATCGAGTGCACCTACACCCTGCTGAAGACCCTATGCGGCCTAAGAGACCTGCT
ACCAATGAATTAAAAAATGATTAATAAAAAATCACTTACTTGAAATCAGCAATAAGGTCTCTGTTGAAA
TTTTCTCCCAGCAGCACCTCACTTCCCTCTTCCCAACTCTGGTATTCTAAACCCCGTTCAGCGGCATAC
TTTCTCCATACTTTAAAGGGGATGTCAAATTTTAGCTCCTCTCCTGTACCCACAATCTTCATGTCTTTC
TTCCCAGATGACCAAGAGAGTCCGGCTCAGTGACTCCTTCAACCCTGTCTACCCCTATGAAGATGAAAG
CACCTCCCAACACCCCTTTATAAACCCAGGGTTTATTTCCCCAAATGGCTTCACACAAAGCCCAAACGG
AGTTCTTACTTTAAAATGTTTAACCCCACTAACAACCACAGGCGGATCTCTACAGCTAAAAGTGGGAGG
GGGACTTACAGTGGATGACACCAACGGTTTTTTGAAAGAAAACATAAGTGCCACCACACCACTCGTTAA
GACTGGTCACTCTATAGGTTTACCACTAGGAGCCGGATTGGGAACGAATGAAAATAAACTTTGTATCAA
ATTAGGACAAGGACTTACATTCAATTCAAACAACATTTGCATTGATGACAATATTAACACCTTATGGAC
AGGAGTCAACCCCACCGAAGCCAACTGTCAAATCATGAACTCCAGTGAATCTAATGATTGCAAATTAAT
TCTAACACTAGTTAAAACTGGAGCACTAGTCACTGCATTTGTTTATGTTATAGGAGTATCTAACAATTT
TAATATGCTAACTACACACAGAAATATAAATTTACTGCAGAGCTGTTTTTCGATTCTACTGGTAATTT
ACTAACTAGACTCTCATCCCTCAAAACTCCACTTAATCATAAATCAGGACAAAACATGGCTACTGGTGC
CATTACTAATGCTAAAGGTTTCATGCCCAGCACGACTGCCTATCCTTTCAATGATAATTCTAGAGAAAA
AGAAAACTACATTTACGGAACTTGTTACTACACAGCTAGTGATCGCACTGCTTTTCCCATTGACATATC
TGTCATGCTTAACCGAAGAGCAATAAATGACGAGACATCATATTGTATTCGTATAACTTGGTCCTGGAA
CACAGGAGATGCCCCAGAGGTGCAAACCTCTGCTACAACCCTAGTCACCTCCCCATTTACCTTTTACTA
CATCAGAGAAGACGACTGACAAATAAAGTTTGCGATCGCCAGGCCCACCATGGGATGGAGCTGTATCAT
CCTCTTCTTGGTAGCAACAGCTACAGGTGTCCACTCCCAGGTGCAGCTGCAGCAGTCTGGGGCTGAACT
GGCAAGACCTGGGGCCTCAGTGAAGATGTCCTGCAAGGCTTCTGGCTACACCTTTACTAGGTACACGAT
GCACTGGGTAAAACAGAGGCCTGGACAGGGTCTGGAATGGATTGGATACATTAATCCTAGCCGTGGTTA
TACTAATTACAATCAGAAGTTCAAGGACAAGGCCACATTGACTACAGACAAATCCTCCAGCACAGCCTA
CATGCAACTGAGCAGCCTGACATCTGAGGACTCTGCAGTCTATTACTGTGCAAGATATTATGATGATCA
TTACTGCCTTGACTACTGGGGCCAAGGCACCACTCTCACAGTCTCCTCAGGTGGCGGTGGCTCGGGCGG
TGGTGGATCTGGTGGCGGCGGATCTGATATCGTGCTCACTCAGTCTCCAGCAATCATGTCTGCATCTCC
AGGGGAGAAGGTCACCATGACCTGCAGTGCCAGCTCAAGTGTAAGTTACATGAACTGGTACCAGCAGAA
GTCAGGCACCTCCCCCAAAAGATGGATTTATGACACATCCAAACTGGCTTCTGGAGTCCCTGCTCACTT
CAGGGGCAGTGGGTCTGGGACCTCTTACTCTCTCACAATCAGCGGCATGGAGGCTGAAGATGCTGCCAC
TTATTACTGCCAGCAGTGGAGTAGTAACCCATTCACGTTCGGCTCGGGGACAAAGTTGGAAATAAACCG
```

Figure 65 continued

```
GGGATCCGAACAAAAACTCATCTCAGAAGAGGATCTGAATGCTGTGGGCCAGGACACGCAGGAGGTCAT
CGTGGTGCCACACTCCTTGCCCTTTAAGGTGGTGGTGATCTCAGCCATCCTGGCCCTGGTGGTGCTCAC
CATCATCTCCCTTATCATCCTCATCATGCTTTGGCAGAAGAAGCCACGTGGTTCAATCCCTAACCCTCT
CCTCGGTCTCGATGGAAGCGGAGCTACTAACTTCAGCCTGCTGAAGCAGGCTGGAGACGTGGAGGAGAA
CCCTGGACCTGGCCACACACGGAGGCAGGGAACATCACCATCCAAGTGTCCATACCTCAATTTCTTTCA
GCTCTTGGTGCTGGCTGGTCTTTCTCACTTCTGTTCAGGTGTTATCCACGTGACCAAGGAAGTGAAAGA
AGTGGCAACGCTGTCCTGTGGTCACAATGTTTCTGTTGAAGAGCTGGCACAAACTCGCATCTACTGGCA
AAAGGAGAAGAAAATGGTGCTGACTATGATGTCTGGGGACATGAATATATGGCCCGAGTACAAGAACCG
GACCATCTTTGATATCACTAATAACCTCTCCATTGTGATCCTGGCTCTGCGCCCATCTGACGAGGGCAC
ATACGAGTGTGTTGTTCTGAAGTATGAAAAGACGCTTTCAAGCGGGAACACCTGGCTGAAGTGACGTT
ATCAGTCAAAGCTGACTTCCCTACACCTAGTATATCTGACTTTGAAATTCCAACTTCTAATATTAGAAG
GATAATTTGCTCAACCTCTGGAGGTTTTCCAGAGCCTCACCTCTCCTGGTTGGAAAATGGAGAAGAATT
AAATGCCATCAACACAACAGTTTCCCAAGATCCTGAAACTGAGCTCTATGCTGTTAGCAGCAAACTGGA
TTTCAATATGACAACCAACCACAGCTTCATGTGTCTCATCAAGTATGGACATTTAAGAGTGAATCAGAC
CTTCAACTGGAATACAACCAAGCAAGAGCATTTTCCTGATAACCTGCTCCCATCCTGGGCCATTACCTT
AATCTCAGTAAATGGAATTTTTGTGATATGCTGCCTGACCTACTGCTTTGCCCCAAGATGCAGAGAGAG
AAGGAGGAATGAGAGATTGAGAAGGGAAAGTGTACGCCCTGTATAAGCTAGCTTGACTGACTGAGATAC
AGCGTACCTTCAGCTCACAGACATGATAAGATACATTGATGAGTTTGGACAAACCACAACTAGAATGCA
GTGAAAAAAATGCTTTATTTGTGAAATTTGTGATGCTATTGCTTTATTTGTAACCATTATAAGCTGCAA
TAAACAAGTTAACAACAACAATTGCATTCATTTTATGTTTCAGGTTCAGGGGGAGGTGTGGGAGGTTTT
TTAAAGCAAGTAAAACCTCTACAAATGTGGTAGTCGTCAGCTATCCTGCAGGAACTTGTTTATTTGAAA
ATCAATTCACAAAATCCGAGTAGTTATTTTGCCTCCCCCTTCCCATTTAACAGAATACACCAATCTCTC
CCCACGCACAGCTTTAAACATTTGGATACCATTAGATATAGACATGGTTTTAGATTCCACATTCCAAAC
AGTTTCAGAGCGAGCCAATCTGGGGTCAGTGATAGATAAAAATCCATCGGGATAGTCTTTTAAAGCGCT
TTCACAGTCCAACTGCTGCGGATGCGACTCCGGAGTCTGGATCACGGTCATCTGGAAGAAGAACGATGG
GAATCATAATCCGAAAACGGTATCGGACGATTGTGTCTCATCAAACCCACAAGCAGCCGCTGTCTGCGT
CGCTCCGTGCGACTGCTGTTTATGGGATCAGGGTCCACAGTGTCCTGAAGCATGATTTAATAGCCCTT
AACATCAACTTTCTGGTGCGATGCGCGCAGCAACGCATTCTGATTTCACTCAAATCTTTGCAGTAGGTA
CAACACATTATTACAATATTGTTTAATAAACCATAATTAAAAGCGCTCCAGCCAAAACTCATATCTGAT
ATAATCGCCCCTGCATGACCATCATACCAAAGTTTAATATAAATTAAATGACGTTCCCTCAAAAACACA
CTACCCACATACATGATCTCTTTTGGCATGTGCATATTAACAATCTGTCTGTACCATGGACAACGTTGG
TTAATCATGCAACCCAATATAACCTTCCGGAACCACACTGCCAACACCGCTCCCCAGCCATGCATTGA
AGTGAACCCTGCTGATTACAATGACAATGAAGAACCCAATTCTCTCGACCGTGAATCACTTGAGAATGA
AAAATATCTATAGTGGCACAACATAGACATAAATGCATGCATCTTCTCATAATTTTTAACTCCTCAGGA
TTTAGAAACATATCCCAGGGAATAGGAAGCTCTTGCAGAACAGTAAAGCTGGCAGAACAAGGAAGACCA
CGAACACAACTTACACTATGCATAGTCATAGTATCACAATCTGGCAACAGCGGGTGGTCTTCAGTCATA
GAAGCTCGGGTTTCATTTTCCTCACAACGTGGTAACTGGGCTCTGGTGTAAGGGTGATGTCTGGCGCAT
GATGTCGAGCGTGCGCGCAACCTTGTCATAATGGAGTTGCTTCCTGACATTCTCGTATTTGTATAGCA
AAACGCGGCCCTGGCAGAACACACTCTTCTTCGCCTTCTATCCTGCCGCTTAGCGTGTTCCGTGTGATA
GTTCAAGTACAACCACACTCTTAAGTTGGTCAAAAGAATGCTGGCTTCAGTTGTAATCAAAACTCCATC
GCATCTAATCGTTCTGAGGAAATCATCCAAGCAATGCAACTGGATTGTGTTTCAAGCAGGAGAGGAGAG
GGAAGAGACGGAAGAACCATGTTAATTTTATTCCAAACGATCTCGCAGTACTTCAAATTGTAGATCGC
GCAGATGGCATCTCTCGCCCCACTGTGTTGGTGAAAAGCACAGCTAGATCAAAAGAAATGCGATTTT
CAAGGTGCTCAACGGTGGCTTCCAGCAAAGCCTCCACGCGCACATCCAAGAACAAAAGAATACCAAAAG
AAGGAGCATTTTCTAACTCCTCAATCATCATATTACATTCCTGCACCATTCCCAGATAATTTTCAGCTT
TCCAGCCTTGAATTATTCGTGTCAGTTCTTGTGGTAAATCCAATCCACACATTACAAACAGGTCCCGGA
GGGCGCCCTCCACCACCATTCTTAAACACACCCTCATAATGACAAAATATCTTGCTCCTGTGTCACCTG
TAGCGAATTGAGAATGGCAACATCAATTGACATGCCCTTGGCTCTAAGTTCTTCTTTAAGTTCTAGTTG
TAAAAACTCTCTCATATTATCACCAAACTGCTTAGCCAGAAGCCCCCGGGAACAAGAGCAGGGGACGC
TACAGTGCAGTACAAGCGCAGACCTCCCCAATTGGCTCCAGCAAAAACAAGATTGGAATAAGCATATTG
GGAACCGCCAGTAATATCATCGAAGTTGCTGGAAATATAATCAGGCAGAGTTTCTTGTAAAAATTGAAT
AAAAGAAAAATTTGCCAAAAAAACATTCAAAACCTCTGGGATGCAAATGCAATAGGTTACCGCGCTGCG
```

Figure 65 continued

```
CTCCAACATTGTTAGTTTTGAATTAGTCTGCAAAAATAAAAAAAAAAACAAGCGTCATATCATAGTAGC
CTGACGAACAGATGGATAAATCAGTCTTTCCATCACAAGACAAGCCACAGGGTCTCCAGCTCGACCCTC
GTAAAACCTGTCATCATGATTAAACAACAGCACCGAAAGTTCCTCGCGGTGACCAGCATGAATAATTCT
TGATGAAGCATACAATCCAGACATGTTAGCATCAGTTAACGAGAAAAAACAGCCAACATAGCCTTTGGG
TATAATTATGCTTAATCGTAAGTATAGCAAAGCCACCCCTCGCGGATACAAAGTAAAAGGCACAGGAGA
ATAAAAAATATAATTATTTCTCTGCTGCTGTTCAGGCAACGTCGCCCCGGTCCCTCTAAATACACATA
CAAAGCCTCATCAGCCATGGCTTACCAGACAAAGTACAGCGGGCACACAAAGCACAAGCTCTAAAGTGA
CTCTCCAACCTCTCCACAATATATATATACACAAGCCCTAAACTGACGTAATGGGAGTAAAGTGTAAAA
AATCCCGCCAAACCCAACACACACCCCGAAACTGCGTCACCAGGGAAAAGTACAGTTTCACTTCCGCAA
TCCCAACAGGCGTAACTTCCTCTTTCTCACGGTACGTGATATCCCACTAACTTGCAACGTCATTTTCCC
ACGGTCGCACCGCCCCTTTTAGCCGTTAACCCCACAGCCAATCACCACACGATCCACACTTTTTAAAAT
CACCTCATTTACATATTGGCACCATTCCATCTATAAGGTATATTATATAGATAGA
```

Figure 66
SEQ ID NO. 103 NG-420 virus genome sequence comprising the EnAd genome with a transgene cassette that encodes a membrane-anchored chimeric form of the single chain Fv anti-human CD3e inserted in the region Bγ. The transgene cassette contains a 5' SSA, membrane-anchored anti-CD3ε cDNA sequence and a 3' poly(A) sequence

```
TCTATCTATATAATATACCTTATAGATGGAATGGTGCCAATATGTAAATGAGGTGATTTTAAAAAGTGT
GGATCGTGTGGTGATTGGCTGTGGGGTTAACGGCTAAAAGGGGCGGTGCGACCGTGGGAAAATGACGTT
TTGTGGGGGTGGAGTTTTTTTGCAAGTTGTCGCGGGAAATGTGACGCATAAAAAGGCTTTTTCTCACG
GAACTACTTAGTTTTCCCACGGTATTTAACAGGAAATGAGGTAGTTTTGACCGGATGCAAGTGAAAATT
GTTGATTTTCGCGCGAAAACTGAATGAGGAAGTGTTTTTCTGAATAATGTGGTATTTATGGCAGGGTGG
AGTATTTGTTCAGGGCCAGGTAGACTTTGACCCATTACGTGGAGGTTTCGATTACCGTGTTTTTTACCT
GAATTTCCGCGTACCGTGTCAAAGTCTTCTGTTTTACGTAGGTGTCAGCTGATCGCTAGGGTATTTAT
ACCTCAGGGTTTGTGTCAAGAGGCCACTCTTGAGTGCCAGCGAGAAGAGTTTTCTCCTCTGCGCCGGCA
GTTTAATAATAAAAAAATGAGAGATTTGCGATTTCTGCCTCAGGAAATAATCTCTGCTGAGACTGGAAA
TGAAATATTGGAGCTTGTGGTGCACGCCCTGATGGGAGACGATCCGGAGCCACCTGTGCAGCTTTTTGA
GCCTCCTACGCTTCAGGAACTGTATGATTTAGAGGTAGAGGGATCGGAGGATTCTAATGAGGAAGCTGT
AAATGGCTTTTTTACCGATTCTATGCTTTTAGCTGCTAATGAAGGGTTAGAATTAGATCCGCCTTTGGA
CACTTTTGATACTCCAGGGGTAATTGTGGAAAGCGGTACAGGTGTAAGAAAATTACCTGATTTGAGTTC
CGTGGACTGTGATTTGCACTGCTATGAAGACGGGTTTCCTCCGAGTGATGAGGAGGACCATGAAAAGGA
GCAGTCCATGCAGACTGCAGCGGGTGAGGGAGTGAAGGCTGCCAATGTTGGTTTTCAGTTGGATTGCCC
GGAGCTTCCTGGACATGGCTGTAAGTCTTGTGAATTTCACAGGAAAAATACTGGAGTAAAGGAACTGTT
ATGTTCGCTTTGTTATATGAGAACGCACTGCCACTTTATTTACAGTAAGTGTGTTTAAGTTAAAATTTA
AAGGAATATGCTGTTTTTCACATGTATATTGAGTGTGAGTTTTGTGCTTCTTATTATAGGTCCTGTGTC
TGATGCTGATGAATCACCATCTCCTGATTCTACTACCTCACCTCCTGAGATTCAAGCACCTGTTCCTGT
GGACGTGCGCAAGCCCATTCCTGTGAAGCTTAAGCCTGGGAAACGTCCAGCAGTGGAAAAACTTGAGGA
CTTGTTACAGGGTGGGGACGGACCTTTGGACTTGAGTACACGGAAACGTCCAAGACAATAAGTGTTCCA
TATCCGTGTTTACTTAAGGTGACGTCAATATTTGTGTGACAGTGCAATGTAATAAAAATATGTTAACTG
TTCACTGGTTTTTATTGCTTTTGGGCGGGGACTCAGGTATATAAGTAGAAGCAGACCTGTGTGGTTAG
CTCATAGGAGCTGGCTTTCATCCATGGAGGTTTGGGCCATTTTGGAAGACCTTAGGAAGACTAGGCAAC
TGTTAGAGAACGCTTCGGACGGAGTCTCCGGTTTTTGGAGATTCTGGTTCGCTAGTGAATTAGCTAGGG
TAGTTTTAGGATAAACAGGACTATAAACAAGAATTTGAAAGTTGTTGGTAGATTGCCCAGGACTTT
TTGAAGCTCTTAATTTGGGCCATCAGGTTCACTTTAAAGAAAAGTTTTATCAGTTTTAGACTTTTCAA
CCCCAGGTAGAACTGCTGCTGCTGTGGCTTTTCTTACTTTTATATTAGATAAATGGATCCCGCAGACTC
ATTTCAGCAGGGGATACGTTTTGGATTTCATAGCCACAGCATTGTGGAGAACATGGAAGGTTCGCAAGA
TGAGGACAATCTTAGGTTACTGGCCAGTGCAGCCTTTGGGTGTAGCGGGAATCCTGAGGCATCCACCGG
TCATGCCAGCGGTTCTGGAGGAGGAACAGCAAGAGGACAACCCGAGAGCCGGCCTGGACCCTCCAGTGG
```

Figure 66 continued

```
AGGAGGCGGAGTAGCTGACTTGTCTCCTGAACTGCAACGGGTGCTTACTGGATCTACGTCCACTGGACG
GGATAGGGGCGTTAAGAGGGAGAGGGCATCTAGTGGTACTGATGCTAGATCTGAGTTGGCTTTAAGTTT
AATGAGTCGCAGACGTCCTGAAACCATTTGGTGGCATGAGGTTCAGAAAGAGGGAAGGGATGAAGTTTC
TGTATTGCAGGAGAAATATTCACTGGAACAGGTGAAAACATGTTGGTTGGAGCCTGAGGATGATTGGGA
GGTGGCCATTAAAAATTATGCCAAGATAGCTTTGAGGCCTGATAAACAGTATAAGATTACTAGACGGAT
TAATATCCGGAATGCTTGTTACATATCTGGAAATGGGGCTGAGGTGGTAATAGATACTCAAGACAAGGC
AGTTATTAGATGCTGCATGATGGATATGTGGCCTGGGGTAGTCGGTATGGAAGCAGTAACTTTTGTAAA
TGTTAAGTTTAGGGGAGATGGTTATAATGGAATAGTGTTTATGGCCAATACCAAACTTATATTGCATGG
TTGTAGCTTTTTGGTTTCAACAATACCTGTGTAGATGCCTGGGGACAGGTTAGTGTACGGGGATGTAG
TTTCTATGCGTGTTGGATTGCCACAGCTGGCAGAACCAAGAGTCAATTGTCTCTGAAGAAATGCATATT
TCAAAGATGTAACCTGGGCATTCTGAATGAAGGCGAAGCAAGGGTCCGCCACTGCGCTTCTACAGATAC
TGGATGTTTTATTTTGATTAAGGGAAATGCCAGCGTAAAGCATAACATGATTTGCGGTGCTTCCGATGA
GAGGCCTTATCAAATGCTCACTTGTGCTGGTGGGCATTGTAATATGCTGGCTACTGTGCATATTGTTTC
CCATCAACGCAAAAAATGGCCTGTTTTTGATCACAATGTGATGACGAAGTGTACCATGCATGCAGGTGG
GCGTAGAGGAATGTTTATGCCTTACCAGTGTAACATGAATCATGTGAAAGTGTTGTTGGAACCAGATGC
CTTTTCCAGAATGAGCCTAACAGGAATTTTTGACATGAACATGCAAATCTGGAAGATCCTGAGGTATGA
TGATACGAGATCGAGGGTACGCGCATGCGAATGCGGAGGCAAGCATGCCAGGTTCCAGCCGGTGTGTGT
AGATGTGACTGAAGATCTCAGACCGGATCATTTGGTTATTGCCCGCACTGGAGCAGAGTTCGGATCCAG
TGGAGAAGAAACTGACTAAGGTGAGTATTGGGAAAACTTTGGGGTGGGATTTTCAGATGGACAGATTGA
GTAAAAATTTGTTTTTTCTGTCTTGCAGCTGTCATGAGTGGAAACGCTTCTTTTAAGGGGGAGTCTTC
AGCCCTTATCTGACAGGGCGTCTCCCATCCTGGGCAGGAGTTCGTCAGAATGTTATGGGATCTACTGTG
GATGGAAGACCCGTCCAACCCGCCAATTCTTCAACGCTGACCTATGCTACTTTAAGTTCTTCACCTTTG
GACGCAGCTGCAGCTGCCGCCGCCGCTTCTGTTGCCGCTAACACTGTGCTTGGAATGGGTTACTATGGA
AGCATCATGGCTAATTCCACTTCCTCTAATAACCCTTCTACCCTGACTCAGGACAAGTTACTTGTCCTT
TTGGCCCAGCTGGAGGCTTTGACCCAACGTCTGGGTGAACTTTCTCAGCAGGTGGTCGAGTTGCGAGTA
CAAACTGAGTCTGCTGTCGGCACGGCAAAGTCTAAATAAAAAAATCCCAGAATCAATGAATAAATAAAC
AAGCTTGTTGTTGATTTAAAATCAAGTGTTTTTATTTCATTTTTCGCGCACGGTATGCCCTAGACCACC
GATCTCTATCATTGAGAACTCGGTGGATTTTTTCCAGGATCCTATAGAGGTGGGATTGAATGTTTAGAT
ACATGGGCATTAGGCCGTCTTTGGGGTGGAGATAGCTCCATTGAAGGGATTCATGCTCCGGGGTAGTGT
TGTAAATCACCCAGTCATAACAAGGTCGCAGTGCATGGTGTTGCACAATATCTTTTAGAAGTAGGCTGA
TTGCCACAGATAAGCCCTTGGTGTAGGTGTTTACAAACCGGTTGAGCTGGGATGGGTGCATTCGGGGTG
AAATTATGTGCATTTTGGATTGGATTTTTAAGTTGGCAATATTGCCGCCAAGATCCCGTCTTGGGTTCA
TGTTATGAAGGACCACCAAGACGGTGTATCCGGTACATTTAGGAAATTTATCGTGCAGCTTGGATGGAA
AAGCGTGGAAAAATTTGGAGACACCCTTGTGTCCTCCAAGATTTTCCATGCACTCATCCATGATAATAG
CAATGGGCCGTGGGCAGCGGCGCGGGCAAACACGTTCCGTGGGTCTGACACATCATAGTTATGTTCCT
GAGTTAAATCATCATAAGCCATTTTAATGAATTTGGGGCGGAGAGTACCAGATTGGGGTATGAATGTTC
CTTCGGGCCCCGGAGCATAGTTCCCCTCACAGATTTGCATTTCCCAAGCTTTCAGTTCCGAGGGTGGAA
TCATGTCCACCTGGGGGCTATGAAAACACCGTTTCTGGGGCGGGGTGATTAATTGTGATGATAGCA
AATTTCTGAGCAATTGAGATTTGCCACATCCGGTGGGGCCATAAATGATTCCGATTACGGGTTGCAGGT
GGTAGTTTAGGGAACGGCAACTGCCGTCTTCTCGAAGCAAGGGGCCACCTCGTTCATCATTTCCCTTA
CATGCATATTTTCCCGCACCAAATCCATTAGGAGGCGCTCTCCTCCTAGTGATAGAAGTTCTTGTAGTG
AGGAAAGTTTTTCAGCGGTTTCAGACCGTCAGCCATGGGCATTTGGAGAGAGTTTGCTGCAAAAGTT
CTAGTCTGTTCCACAGTTCAGTGATGTGTTCTATGGCATCTCGATCCAGCAGACCTCCTCGTTTCGCGG
GTTTGGACGGCTCCTGGAATAGGGTATGAGACGATGGGCGTCCAGCGCTGCCAGGGTTCGGTCCTTCA
GGGTCTCAGTGTTCGAGTCAGGGTTGTTTCCGTCACAGTGAAGGGGTGTGCGCCTGCTTGGGCGCTTGC
CAGGGTGCGCTTCAGACTCATCCTGCTGGTCGAAAACTTCTGTCGCTTGGCGCCCTGTATGTCGGCCAA
GTAGCAGTTTACCATGAGTTCGTAGTTGAGCGCCTCGGCTGCGTGGCCTTTGGCGCGGAGCTTACCTTT
GGAAGTTTTCTTGCATACCGGGCAGTATAGGCATTTCAGCGCATACAACTTGGGCGCAAGGAAAACGGA
TTCTGGGGAGTATGCATCTGCGCCGCAGGAGGCGCAAACAGTTTCACATTCCACCAGCCAGGTTAAATC
```

Figure 66 continued

```
CGGTTCATTGGGGTCAAAAACAAGTTTTCCGCCATATTTTTTGATGCGTTTCTTACCTTTGGTCTCCAT
GAGTTCGTGTCCTCGTTGAGTGACAAACAGGCTGTCCGTGTCCCCGTAGACTGATTTTACAGGCCTCTT
CTCCAGTGGAGTGCCTCGGTCTTCTTCGTACAGGAACTCTGACCACTCTGATACAAAGGCGCGCGTCCA
GGCCAGCACAAAGGAGGCTATGTGGGAGGGGTAGCGATCGTTGTCAACCAGGGGGTCCACCTTTTCCAA
AGTATGCAAACACATGTCACCCTCTTCAACATCCAGGAATGTGATTGGCTTGTAGGTGTATTTCACGTG
ACCTGGGGTCCCCGCTGGGGGGGTATAAAAGGGGGCGGTTCTTTGCTCTTCCTCACTGTCTTCCGGATC
GCTGTCCAGGAACGTCAGCTGTTGGGGTAGGTATTCCCTCTCGAAGGCGGGCATGACCTCTGCACTCAG
GTTGTCAGTTTCTAAGAACGAGGAGGATTTGATATTGACAGTGCCGGTTGAGATGCCTTTCATGAGGTT
TTCGTCCATCTGGTCAGAAAACACAATTTTTTATTGTCAAGTTTGGTGGCAAATGATCCATACAGGGC
GTTGGATAAAAGTTTGGCAATGGATCGCATGGTTTGGTTCTTTTCCTTGTCCGCGCGCTCTTTGGCGGC
GATGTTGAGTTGGACATACTCGCGTGCCAGGCACTTCCATTCGGGGAAGATAGTTGTTAATTCATCTGG
CACGATTCTCACTTGCCACCCTCGATTATGCAAGGTAATTAAATCCACACTGGTGGCCACCTCGCCTCG
AAGGGGTTCATTGGTCCAACAGAGCCTACCTCCTTTCCTAGAACAGAAAGGGGGAAGTGGGTCTAGCAT
AAGTTCATCGGGAGGGTCTGCATCCATGGTAAAGATTCCCGGAAGTAAATCCTTATCAAAATAGCTGAT
GGGAGTGGGGTCATCTAAGGCCATTTGCCATTCTCGAGCTGCCAGTGCGCGCTCATATGGGTTAAGGGG
ACTGCCCCATGGCATGGGATGGGTGAGTGCAGAGGCATACATGCCACAGATGTCATAGACGTAGATGGG
ATCCTCAAAGATGCCTATGTAGGTTGGATAGCATCGCCCCCTCTGATACTTGCTCGCACATAGTCATA
TAGTTCATGTGATGGCGCTAGCAGCCCCGGACCCAAGTTGGTGCGATTGGGTTTTTCTGTTCTGTAGAC
GATCTGGCGAAAGATGGCGTGAGAATTGGAAGAGATGGTGGGTCTTTGAAAAATGTTGAAATGGGCATG
AGGTAGACCTACAGAGTCTCTGACAAAGTGGGCATAAGATTCTTGAAGCTTGGTTACCAGTTCGGCGGT
GACAAGTACGTCTAGGGCGCAGTAGTCAAGTGTTTCTTGAATGATGTCATAACCTGGTTGGTTTTTCTT
TTCCCACAGTTCGCGGTTGAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGGCAGCAGCCCTTCTC
TACGGGTAGAGAGTATGCTTGAGCAGCTTTTCGTAGCGAAGCGTGAGTAAGGGCAAAGGTGTCTCTGAC
CATGACTTTGAGGAATTGGTATTTGAAGTCGATGTCGTCACAGGCTCCCTGTTCCCAGAGTTGGAAGTC
TACCCGTTTCTTGTAGGCGGGGTTGGGCAAAGCGAAAGTAACATCATTGAAGAGAATCTTGCCGGCCCT
GGGCATGAAATTGCGAGTGATGCGAAAAGGCTGTGGTACTTCCGCTCGGTTATTGATAACCTGGGCAGC
TAGGACGATCTCGTCGAAACCGTTGATGTTGTGTCCTACGATGTATAATTCTATGAAACGCGGCGTGCC
TCTGACGTGAGGTAGCTTACTGAGCTCATCAAAGGTTAGGTCTGTGGGGTCAGATAAGGCGTAGTGTTC
GAGAGCCCATTCGTGCAGGTGAGGATTCGCTTTAAGGAAGGAGGACCAGAGGTCCACTGCCAGTGCTGT
TTGTAACTGGTCCCGGTACTGACGAAAATGCCGTCCGACTGCCATTTTTCTGGGGTGACGCAATAGAA
GGTTTGGGGGTCCTGCCGCCAGCGATCCCACTTGAGTTTTATGGCGAGGTCATAGGCGATGTTGACGAG
CCGCTGGTCTCCAGAGAGTTTCATGACCAGCATGAAGGGGATTAGCTGCTTGCCAAAGGACCCCATCCA
GGTGTAGGTTTCCACATCGTAGGTGAGAAAGAGCCTTTCTGTGCGAGGATGAGAGCCAATCGGGAAGAA
CTGGATCTCCTGCCACCAGTTGGAGGAATGGCTGTTGATGTGATGGAAGTAGAACTCCCTGCGACGCGC
CGAGCATTCATGCTTGTGCTTGTACAGACGGCCGCAGTAGTCGCAGCGTTGCACGGGTTGTATCTCGTG
AATGAGTTGTACCTGGCTTCCCTTGACGAGAAATTTCAGTGGGAAGCCGAGGCCTGGCGATTGTATCTC
GTGCTTTACTATGTTGTCTGCATCGGCCTGTTCATCTTCTGTCTCGATGGTGGTCATGCTGACGAGCCC
TCGCGGGAGGCAAGTCCAGACCTCGGCGCGGCAGGGGCGGAGCTCGAGGACGAGAGCGCGCAGGCTGGA
GCTGTCCAGGGTCCTGAGACGCTGCGGACTCAGGTTAGTAGGCAGTGTCAGGAGATTAACTTGCATGAT
CTTTTGGAGGGCGTGCGGGAGGTTCAGATAGTACTTGATCTCAACGGGTCCGTTGGTGGAGATGTCGAT
GGCTTGCAGGGTTCCGTGTCCCTTGGGCGCTACCACCGTGCCCTTGTTTTTCATTTTGGACGGCGGTGG
CTCTGTTGCTTCTTGCATGTTTAGAAGCGGTGTCGAGGGCGCGCACCGGGCGGCAGGGCGGCTCGGGA
CCCGGCGGCATGGCTGGCAGTGGTACGTCGGCGCCGCGCGGGTAGGTTCTGGTACTGCGCCCTGAGA
AGACTCGCATGCGCGACGACGCGGCGGTTGACATCCTGGATCTGACGCCTCTGGGTGAAAGCTACCGGC
CCCGTGAGCTTGAACCTGAAAGAGAGTTCAACAGAATCAATCTCGGTATCGTTGACGGCGGCTTGCCTA
AGGATTTCTTGCACGTCACCAGAGTTGTCCTGGTAGGCGATCTCCGCCATGAACTGCTCGATCTCTTCC
TCTTGAAGATCTCCGCGGCCCGCTCTCTCGACGGTGGCCGCGAGGTCGTTGGAGATGCGCCCAATGAGT
TGAGAGAATGCATTCATGCCCGCCTCGTTCCAGACGCGGCTGTAGACCACGGCCCCCACGGGATCTCTC
```

Figure 66 continued

```
GCGCGCATGACCACCTGGGCGAGGTTGAGCTCCACGTGGCGGGTGAAGACCGCATAGTTGCATAGGCGC
TGGAAAAGGTAGTTGAGTGTGGTGGCGATGTGCTCGGTGACGAAGAAATACATGATCCATCGTCTCAGC
GGCATCTCGCTGACATCGCCCAGAGCTTCCAAGCGCTCCATGGCCTCGTAGAAGTCCACGGCAAAATTA
AAAAACTGGGAGTTTCGCGCGGACACGGTCAACTCCTCTTCCAGAAGACGGATAAGTTCGGCGATGGTG
GTGCGCACCTCGCGCTCGAAAGCCCCTGGGATTTCTTCCTCAATCTCTTCTTCTTCCACTAACATCTCT
TCCTCTTCAGGTGGGGCTGCAGGAGGAGGGGGAACGCGGCGACGCCGGCGGCGCACGGGCAGACGGTCG
ATGAATCTTTCAATGACCTCTCCGCGGCGGCGGCGCATGGTTTCAGTGACGGCGCGGCCGTTCTCGCGC
GGTCGCAGAGTAAAAACACCGCCGCGCATCTCCTTAAAGTGGTGACTGGGAGGTTCTCCGTTTGGGAGG
GAGAGGGCGCTGATTATACATTTTATTAATTGGCCCGTAGGGACTGCACGCAGAGATCTGATCGTGTCA
AGATCCACGGGATCTGAAAACCTTTCGACGAAAGCGTCTAACCAGTCACAGTCACAAGGTAGGCTGAGT
ACGGCTTCTTGTGGGCGGGGGTGGTTATGTGTTCGGTCTGGGTCTTCTGTTTCTTCTTCATCTCGGGAA
GGTGAGACGATGCTGCTGGTGATGAAATTAAAGTAGGCAGTTCTAAGACGGCGGATGGTGGCGAGGAGC
ACCAGGTCTTTGGGTCCGGCTTGCTGGATACGCAGGCGATTGGCCATTCCCCAAGCATTATCCTGACAT
CTAGCAAGATCTTTGTAGTAGTCTTGCATGAGCCGTTCTACGGGCACTTCTTCCTCACCCGTTCTGCCA
TGCATACGTGTGAGTCCAAATCCGCGCATTGGTTGTACCAGTGCCAAGTCAGCTACGACTCTTTCGGCG
AGGATGGCTTGCTGTACTTGGGTAAGGGTGGCTTGAAAGTCATCAAAATCCACAAAGCGGTGGTAAGCT
CCTGTATTAATGGTGTAAGCACAGTTGGCCATGACTGACCAGTTAACTGTCTGGTGACCAGGGCGCACG
AGCTCGGTGTATTTAAGGCGCGAATAGGCGCGGGTGTCAAAGATGTAATCGTTGCAGGTGCGCACCAGA
TACTGGTACCCTATAAGAAATGCGGCGGTGGTTGGCGGTAGAGAGGCCATCGTTCTGTAGCTGGAGCG
CCAGGGGCGAGGTCTTCCAACATAAGGCGGTGATAGCCGTAGATGTACCTGGACATCCAGGTGATTCCT
GCGGCGGTAGTAGAAGCCCGAGGAAACTCGCGTACGCGGTTCCAAATGTTGCGTAGCGGCATGAAGTAG
TTCATTGTAGGCACGGTTTGACCAGTGAGGCGCGCGCAGTCATTGATGCTCTATAGACACGGAGAAAAT
GAAAGCGTTCAGCGACTCGACTCCGTAGCCTGGAGGAACGTGAACGGGTTGGGTCGCGGTGTACCCCGG
TTCGAGACTTGTACTCGAGCCGGCCGGAGCCGCGGCTAACGTGGTATTGGCACTCCCGTCTCGACCCAG
CCTACAAAAATCCAGGATACGGAATCGAGTCGTTTGCTGGTTTCCGAATGGCAGGGAAGTGAGTCCTA
TTTTTTTTTTTGCCGCTCAGATGCATCCCGTGCTGCGACAGATGCGCCCCAACAACAGCCCCCCTCG
CAGCAGCAGCAGCAGCAATCACAAAAGGCTGTCCCTGCAACTACTGCAACTGCCGCCGTGAGCGGTGCG
GGACAGCCCGCCTATGATCTGGACTTGGAAGAGGGCGAAGGACTGGCACGTCTAGGTGCGCCTTCACCC
GAGCGGCATCCGCGAGTTCAACTGAAAAAGATTCTCGCGAGGCGTATGTGCCCAACAGAACCTATTT
AGAGACAGAAGCGGCGAGGAGCCGGAGGAGATGCGAGCTTCCCGCTTTAACGCGGGTCGTGAGCTGCGT
CACGGTTTGGACCGAAGACGAGTGTTGCGGGACGAGGATTTCGAAGTTGATGAAATGACAGGGATCAGT
CCTGCCAGGGCACACGTGGCTGCAGCCAACCTTGTATCGGCTTACGAGCAGACAGTAAAGGAAGAGCGT
AACTTCCAAAAGTCTTTTAATAATCATGTGCGAACCCTGATTGCCCGCGAAGAAGTTACCCTTGGTTTG
ATGCATTTGTGGGATTTGATGGAAGCTATCATTCAGAACCCTACTAGCAAACCTCTGACCGCCCAGCTG
TTTCTGGTGGTGCAACACAGCAGAGACAATGAGGCTTTCAGAGAGGCGCTGCTGAACATCACCGAACCC
GAGGGGAGATGGTTGTATGATCTTATCAACATTCTACAGAGTATCATAGTGCAGGAGCGGAGCCTGGGC
CTGGCCGAGAAGGTGGCTGCCATCAATTACTCGGTTTTGAGCTTGGGAAAATATTACGCTCGCAAAATC
TACAAGACTCCATACGTTCCCATAGACAAGGAGGTGAAGATAGATGGGTTCTACATGCGCATGACGCTC
AAGGTCTTGACCCTGAGCGATGATCTTGGGGTGTATCGCAATGACAGAATGCATCGCGCGGTTAGCGCC
AGCAGGAGGCGCGAGTTAAGCGACAGGGAACTGATGCACAGTTTGCAAAGAGCTCTGACTGGAGCTGGA
ACCGAGGGTGAGAATTACTTCGACATGGGAGCTGACTTGCAGTGGCAGCCTAGTCGCAGGGCTCTGAGC
GCCGCGACGGCAGGATGTGAGCTTCCTTACATAGAAGAGGCGGATGAAGGCGAGGAGGAAGAGGGCGAG
TACTTGGAAGACTGATGGCACAACCCGTGTTTTTGCTAGATGGAACAGCAAGCACCGGATCCCGCAAT
GCGGGCGGCGCTGCAGAGCCAGCCGTCCGGCATTAACTCCTCGGACGATTGGACCCAGGCCATGCAACG
TATCATGGCGTTGACGACTCGCAACCCCGAAGCCTTTAGACAGCAACCCCAGGCCAACCGTCTATCGGC
CATCATGGAAGCTGTAGTGCCTTCCCGCTCTAATCCCACTCATGAGAAGGTCCTGGCCATCGTGAACGC
GTTGGTGGAGAACAAAGCTATTCGTCCAGATGAGGCCGGACTGGTATACAACGCTCTCTTAGAACGCGT
GGCTCGCTACAACAGTAGCAATGTGCAAACCAATTTGGACCGTATGATAACAGATGTACGCGAAGCCGT
GTCTCAGCGCGAAAGGTTCCAGCGTGATGCCAACCTGGGTTCGCTGGTGGCGTTAAATGCTTTCTTGAG
```

Figure 66 continued

```
TACTCAGCCTGCTAATGTGCCGCGTGGTCAACAGGATTATACTAACTTTTTAAGTGCTTTGAGACTGAT
GGTATCAGAAGTACCTCAGAGCGAAGTGTATCAGTCCGGTCCTGATTACTTCTTTCAGACTAGCAGACA
GGGCTTGCAGACGGTAAATCTGAGCCAAGCTTTTAAAAACCTTAAAGGTTTGTGGGGAGTGCATGCCCC
GGTAGGAGAAAGAGCAACCGTGTCTAGCTTGTTAACTCCGAACTCCCGCCTATTATTACTGTTGGTAGC
TCCTTTCACCGACAGCGGTAGCATCGACCGTAATTCCTATTTGGGTTACCTACTAAACCTGTATCGCGA
AGCCATAGGGCAAAGTCAGGTGGACGAGCAGACCTATCAAGAAATTACCCAAGTCAGTCGCGCTTTGGG
ACAGGAAGACACTGGCAGTTTGGAAGCCACTCTGAACTTCTTGCTTACCAATCGGTCTCAAAAGATCCC
TCCTCAATATGCTCTTACTGCGGAGGAGGAGAGGATCCTTAGATATGTGCAGCAGAGCGTGGGATTGTT
TCTGATGCAAGAGGGGGCAACTCCGACTGCAGCACTGGACATGACAGCGCGAAATATGGAGCCCAGCAT
GTATGCCAGTAACCGACCTTTCATTAACAAACTGCTGGACTACTTGCACAGAGCTGCCGCTATGAACTC
TGATTATTTCACCAATGCCATCTTAAACCCGCACTGGCTGCCCCCACCTGGTTTCTACACGGGCAATA
TGACATGCCCGACCCTAATGACGGATTTCTGTGGGACGACGTGGACAGCGATGTTTTTCACCTCTTTC
TGATCATCGCACGTGGAAAAGGAAGGCGGCGATAGAATGCATTCTTCTGCATCGCTGTCCGGGGTCAT
GGGTGCTACCGCGGCTGAGCCCGAGTCTGCAAGTCCTTTTCCTAGTCTACCCTTTTCTCTACACAGTGT
ACGTAGCAGCGAAGTGGGTAGAATAAGTCGCCCGAGTTTAATGGGCGAAGAGGAGTATCTAAACGATTC
CTTGCTCAGACCGGCAAGAGAAAAAAATTTCCCAAACAATGGAATAGAAAGTTTGGTGGATAAAATGAG
TAGATGGAAGACTTATGCTCAGGATCACAGAGACGAGCCTGGGATCATGGGGATTACAAGTAGAGCGAG
CCGTAGACGCCAGCGCCATGACAGACAGAGGGGTCTTGTGTGGGACGATGAGGATTCGGCCGATGATAG
CAGCGTGCTGGACTTGGGTGGGAGAGGAAGGGGCAACCCGTTTGCTCATTTGCGCCCTCGCTTGGGTGG
TATGTTGTAAAAAAAAATAAAAAAAAAACTCACCAAGGCCATGGCGACGAGCGTACGTTCGTTCTTCTT
TATTATCTGTGTCTAGTATAATGAGGCGAGTCGTGCTAGGCGGAGCGGTGGTGTATCCGGAGGGTCCTC
CTCCTTCGTACGAGAGCGTGATGCAGCAGCAGCAGGCGACGGCGGTGATGCAATCCCCACTGGAGGCTC
CCTTTGTGCCTCCGCGATACCTGGCACCTACGGAGGGCAGAAACAGCATTCGTTATTCGGAACTGGCAC
CTCAGTACGATACCACCAGGTTGTATCTGGTGGACAACAAGTCGGCGGACATTGCTTCTCTGAACTATC
AGAATGACCACAGCAACTTCTTGACCACGGTGGTGCAAAACAATGACTTTACCCCTACGGAAGCCAGCA
CCCAGACCATTAACTTTGATGAACGATCGCGGTGGGCGGTCAGCTAAAGACCATCATGCATACTAACA
TGCCAAACGTGAACGAGTATATGTTTAGTAACAAGTTCAAAGCGCGTGTGATGGTGTCCAGAAAACCTC
CCGACGGTGCTGCAGTTGGGGATACTTATGATCACAAGCAGGATATTTTGAAATATGAGTGGTTCGAGT
TTACTTTGCCAGAAGGCAACTTTTCAGTTACTATGACTATTGATTTGATGAACAATGCCATCATAGATA
ATTACTTGAAAGTGGGTAGACAGAATGGAGTGCTTGAAAGTGACATTGGTGTTAAGTTCGACACCAGGA
ACTTCAAGCTGGGATGGATCCCGAAACCAAGTTGATCATGCCTGGAGTGTATACGTATGAAGCCTTCC
ATCCTGACATTGTCTTACTGCCTGGCTGCGGAGTGGATTTTACCGAGAGTCGTTTGAGCAACCTTCTTG
GTATCAGAAAAAAACAGCCATTTCAAGAGGGTTTTAAGATTTTGTATGAAGATTTAGAAGGTGGTAATA
TTCCGGCCCTCTTGGATGTAGATGCCTATGAGAACAGTAAGAAAGAACAAAAAGCCAAAATAGAAGCTG
CTACAGCTGCTGCAGAAGCTAAGGCAAACATAGTTGCCAGCGACTCTACAAGGGTTGCTAACGCTGGAG
AGGTCAGAGGAGACAATTTTGCGCCAACACCTGTTCCGACTGCAGAATCATTATTGGCCGATGTGTCTG
AAGGAACGGACGTGAAACTCACTATTCAACCTGTAGAAAAGATAGTAAGAATAGAAGCTATAATGTGT
TGGAAGACAAAATCAACACAGCCATCGCAGTTGGTATCTTTCGTACAATTATGGCGATCCCGAAAAAG
GAGTGCGTTCCTGGACATTGCTCACCACCTCAGATGTCACCTGCGGAGCAGAGCAGGTCTACTGGTCGC
TTCCAGACATGATGAAGGATCCTGTCACTTTCCGCTCCACTAGACAAGTCAGTAACTACCCTGTGGTGG
GTGCAGAGCTTATGCCCGTCTTCTCAAAGAGCTTCTACAACGAACAAGCTGTGTACTCCCAGCAGCTCC
GCCAGTCCACCTCGCTTACGCACGTCTTCAACCGCTTTCCTGAGAACCAGATTTTAATCCGTCCGCCGG
CGCCCACCATTACCACCGTCAGTGAAAACGTTCCTGCTCTCACAGATCACGGGACCCTGCCGTTGCGCA
GCAGTATCCGGGGAGTCCAACGTGTGACCGTTACTGACGCCAGACGCCGCACCTGTCCCTACGTGTACA
AGGCACTGGGCATAGTCGCACCGCGCGTCCTTTCAAGCCGCACTTTCTAAAAAAAAAAAAAATGTCCAT
TCTTATCTCGCCCAGTAATAACACCGGTTGGGGTCTGCGCGCTCCAAGCAAGATGTACGGAGGCGCACG
CAAACGTTCTACCCAACATCCTGTCCGTGTTCGCGGACATTTTCGCGCTCCATGGGGCGCCCTCAAGGG
CCGCACTCGCGTTCGAACCACCGTCGATGATGTAATCGATCAGGTGGTTGCCGACGCCCGTAATTATAC
TCCTACTGCGCCTACATCTACTGTGGATGCAGTTATTGACAGTGTAGTGGCTGACGCTCGCAACTATGC
```

Figure 66 continued

```
TCGACGTAAGAGCCGGCGAAGGCGCATTGCCAGACGCCACCGAGCTACCACTGCCATGCGAGCCGCAAG
AGCTCTGCTACGAAGAGCTAGACGCGTGGGGCGAAGAGCCATGCTTAGGGCGGCCAGACGTGCAGCTTC
GGGCGCCAGCGCCGGCAGGTCCCGCAGGCAAGCAGCCGCTGTCGCAGCGGCGACTATTGCCGACATGGC
CCAATCGCGAAGAGGCAATGTATACTGGGTGCGTGACGCTGCCACCGGTCAACGTGTACCCGTGCGCAC
CCGTCCCCCTCGCACTTAGAAGATACTGAGCAGTCTCCGATGTTGTGTCCCAGCGGCGAGGATGTCCAA
GCGCAAATACAAGGAAGAAATGCTGCAGGTTATCGCACCTGAAGTCTACGGCCAACCGTTGAAGGATGA
AAAAAAACCCCGCAAAATCAAGCGGGTTAAAAAGGACAAAAAAGAAGAGGAAGATGGCGATGATGGGCT
GGCGGAGTTTGTGCGCGAGTTTGCCCCACGGCGACGCGTGCAATGGCGTGGGCGCAAAGTTCGACATGT
GTTGAGACCTGGAACTTCGGTGGTCTTTACACCCGGCGAGCGTTCAAGCGCTACTTTTAAGCGTTCCTA
TGATGAGGTGTACGGGGATGATGATATTCTTGAGCAGGCGGCTGACCGATTAGGCGAGTTTGCTTATGG
CAAGCGTAGTAGAATAACTTCCAAGGATGAGACAGTGTCGATACCCTTGGATCATGGAAATCCCACCCC
TAGTCTTAAACCGGTCACTTTGCAGCAAGTGTTACCCGTAACTCCGCGAACAGGTGTTAAACGCGAAGG
TGAAGATTTGTATCCCACTATGCAACTGATGGTACCCAAACGCCAGAAGTTGGAGGACGTTTTGGAGAA
AGTAAAAGTGGATCCAGATATTCAACCTGAGGTTAAAGTGAGACCCATTAAGCAGGTAGCGCCTGGTCT
GGGGGTACAAACTGTAGACATTAAGATTCCCACTGAAAGTATGGAAGTGCAAACTGAACCCGCAAAGCC
TACTGCCACCTCCACTGAAGTGCAAACGGATCCATGGATGCCCATGCCTATTACAACTGACGCCGCCGG
TCCCACTCGAAGATCCCGACGAAAGTACGGTCCAGCAAGTCTGTTGATGCCCAATTATGTTGTACACCC
ATCTATTATTCCTACTCCTGGTTACCGAGGCACTCGCTACTATCGCAGCCGAAACAGTACCTCCCGCCG
TCGCCGCAAGACACCTGCAAATCGCAGTCGTCGCCGTAGACGCACAAGCAAACCGACTCCCGGCGCCCT
GGTGCGGCAAGTGTACCGCAATGGTAGTGCGGAACCTTTGACACTGCCGCGTGCGCGTTACCATCCGAG
TATCATCACTTAATCAATGTTGCCGCTGCCTCCTTGCAGATATGGCCCTCACTTGTCGCCTTCGCGTTC
CCATCACTGGTTACCGAGGAAGAAACTCGCGCCGTAGAAGAGGGATGTTGGGACGCGGAATGCGACGCT
ACAGGCGACGGCGTGCTATCCGCAAGCAATTGCGGGGTGGTTTTTTACCAGCCTTAATTCCAATTATCG
CTGCTGCAATTGGCGCGATACCAGGCATAGCTTCCGTGGCGGTTCAGGCCTCGCAACGACATTGACATT
GGAAAAAAACGTATAAATAAAAAAAAAAAAATACAATGGACTCTGACACTCCTGGTCCTGTGACTATGT
TTTCTTAGAGATGGAAGACATCAATTTTTCATCCTTGGCTCCGCGACACGGCACGAAGCCGTACATGGG
CACCTGGAGCGACATCGGCACGAGCCAACTGAACGGGGGCGCCTTCAATTGGAGCAGTATCTGGAGCGG
GCTTAAAAATTTTGGCTCAACCATAAAAACATACGGGAACAAAGCTTGGAACAGCAGTACAGGACAGGC
GCTTAGAAATAAACTTAAAGACCAGAACTTCCAACAAAAGTAGTCGATGGGATAGCTTCCGGCATCAA
TGGAGTGGTAGATTTGGCTAACCAGGCTGTGCAGAAAAAGATAAACAGTCGTTTGGACCCGCCGCCAGC
AACCCCAGGTGAAATGCAAGTGGAGGAAGAAATTCCTCCGCCAGAAAAACGAGGCGACAAGCGTCCGCG
TCCCGATTTGGAAGAGACGCTGGTGACGCGCGTAGATGAACCGCCTTCTTATGAGGAAGCAACGAAGCT
TGGAATGCCCACCACTAGACCGATAGCCCCAATGGCCACCGGGGTGATGAAACCTTCTCAGTTGCATCG
ACCCGTCACCTTGGATTTGCCCCCTCCCCCTGCTGCTACTGCTGTACCCGCTTCTAAGCCTGTCGCTGC
CCCGAAACCAGTCGCCGTAGCCAGGTCACGTCCCGGGGCGCTCCTCGTCCAAATGCGCACTGGCAAAA
TACTCTGAACAGCATCGTGGGTCTAGGCGTGCAAAGTGTAAAACGCCGTCGCTGCTTTTAATTAAATAT
GGAGTAGCGCTTAACTTGCCTATCTGTGTATATGTGTCATTACACGCCGTCACAGCAGCAGAGGAAAAA
AGGAAGAGGTCGTGCGTCGACGCTGAGTTACTTTCAAGATGGCCACCCCATCGATGCTGCCCCAATGGG
CATACATGCACATCGCCGGACAGGATGCTTCGGAGTACCTGAGTCCGGGTCTGGTGCAGTTCGCCCGCG
CCACAGACACCTACTTCAATCTGGGAAATAAGTTTAGAAATCCCACCGTAGCGCCGACCCACGATGTGA
CCACCGACCGTAGCCAGCGGCTCATGTTGCGCTTCGTGCCCGTTGACCGGGAGGACAATACATACTCTT
ACAAAGTGCGGTACACCCTGGCCGTGGGCGACAACAGAGTGCTGGATATGGCCAGCACGTTCTTTGACA
TTAGGGGTGTGTTGGACAGAGGTCCCAGTTTCAAACCCTATTCTGGTACGGCTTACAACTCCCTGGCTC
CTAAAGGCGCTCCAAATACATCTCAGTGGATTGCAGAAGGTGTAAAAAATACAACTGGTGAGGAACACG
TAACAGAAGAGGAAACCAATACTACTACTTACACTTTTGGCAATGCTCCTGTAAAAGCTGAAGCTGAAA
TTACAAAAGAAGGACTCCCAGTAGGTTTGGAAGTTTCAGATGAAGAAAGTAAACCGATTTATGCTGATA
AAACATATCAGCCAGAACCTCAGCTGGGAGATGAAACTTGGACTGACCTTGATGGAAAAACCGAAAAGT
ATGGAGGCAGGGCTCTCAAACCCGATACTAAGATGAAACCATGCTACGGGTCCTTTGCCAAACCTACTA
ATGTGAAAGGCGGTCAGGCAAAACAAAAAACAACGGAGCAGCCAAATCAGAAAGTCGAATATGATATCG
```

Figure 66 continued

```
ACATGGAGTTTTTTGATGCGGCATCGCAGAAAACAAACTTAAGTCCTAAAATTGTCATGTATGCAGAAA
ATGTAAATTTGGAAACTCCAGACACTCATGTAGTGTACAAACCTGGAACAGAAGACACAAGTTCCGAAG
CTAATTTGGGACAACAATCTATGCCCAACAGACCCAACTACATTGGCTTCAGAGATAACTTTATTGGAC
TTATGTACTATAACAGTACTGGTAACATGGGGGTGCTGGCTGGTCAAGCGTCTCAGTTAAATGCAGTGG
TTGACTTGCAGGACAGAAACACAGAACTTTCTTACCAACTCTTGCTTGACTCTCTGGGCGACAGAACCA
GATACTTTAGCATGTGGAATCAGGCTGTGGACAGTTATGATCCTGATGTACGTGTTATTGAAAATCATG
GTGTGGAAGATGAACTTCCCAACTACTGTTTTCCACTGGACGGCATAGGTGTTCCAACAACCAGTTACA
AATCAATAGTTCCAAATGGAGACAATGCGCCTAATTGGAAGGAACCTGAAGTAAATGGAACAAGTGAGA
TCGGACAGGGTAATTTGTTTGCCATGGAAATTAACCTTCAAGCCAATCTATGGCGAAGTTTCCTTTATT
CCAATGTGGCTCTATATCTCCCAGACTCGTACAAATACACCCCGTCCAATGTCACTCTTCCAGAAAACA
AAAACACCTACGACTACATGAACGGGCGGGTGGTGCCGCCATCTCTAGTAGACACCTATGTGAACATTG
GTGCCAGGTGGTCTCTGGATGCCATGGACAATGTCAACCCATTCAACCACCACCGTAACGCTGGCTTGC
GTTACCGATCCATGCTTCTGGGTAACGGACGTTATGTGCCTTTCCACATACAAGTGCCTCAAAAATTCT
TCGCTGTTAAAAACCTGCTGCTTCTCCAGGCTCCTACACTTATGAGTGGAACTTTAGGAAGGATGTGA
ACATGGTTCTACAGAGTTCCCTCGGTAACGACCTGCGGGTAGATGGCGCCAGCATCAGTTTCACGAGCA
TCAACCTCTATGCTACTTTTTCCCCATGGCTCACAACACCGCTTCCACCCTTGAAGCCATGCTGCGGA
ATGACACCAATGATCAGTCATTCAACGACTACCTATCTGCAGCTAACATGCTCTACCCCATTCCTGCCA
ATGCAACCAATATTCCCATTTCCATTCCTTCTCGCAACTGGGCGGCTTTCAGAGGCTGGTCATTTACCA
GACTGAAAACCAAAGAAACTCCCTCTTTGGGGTCTGGATTTGACCCCTACTTTGTCTATTCTGGTTCTA
TTCCCTACCTGGATGGTACCTTCTACCTGAACCACACTTTTAAGAAGGTTTCCATCATGTTTGACTCTT
CAGTGAGCTGGCCTGGAAATGACAGGTTACTATCTCCTAACGAATTTGAAATAAAGCGCACTGTGGATG
GCGAAGGCTACAACGTAGCCCAATGCAACATGACCAAAGACTGGTTCTTGGTACAGATGCTCGCCAACT
ACAACATCGGCTATCAGGGCTTCTACATTCCAGAAGGATACAAAGATCGCATGTATTCATTTTTCAGAA
ACTTCCAGCCCATGAGCAGGCAGGTGGTTGATGAGGTCAATTACAAAGACTTCAAGGCCGTCGCCATAC
CCTACCAACACAACAACTCTGGCTTTGTGGGTTACATGGCTCCGACCATGCGCCAAGGTCAACCCTATC
CCGCTAACTATCCCTATCCACTCATTGGAACAACTGCCGTAAATAGTGTTACGCAGAAAAAGTTCTTGT
GTGACAGAACCATGTGGCGCATACCGTTCTCGAGCAACTTCATGTCTATGGGGCCCTTACAGACTTGG
GACAGAATATGCTCTATGCCAACTCAGCTCATGCTCTGGACATGACCTTTGAGGTGGATCCCATGGATG
AGCCCACCCTGCTTTATCTTCTTCGAAGTTTTCGACGTGGTCAGAGTGCATCAGCCACACCGCGGCA
TCATCGAGGCAGTCTACCTGCGTACACCGTTCTCGGCCGGTAACGCTACCACGTAAGAAGCTTCTTGCT
TCTTGCAAATAGCAGCTGCAACCATGGCCTGCGGATCCCAAAACGGCTCCAGCGAGCAAGAGCTCAGAG
CCATTGTCCAAGACCTGGGTTGCGGACCCTATTTTTGGGAACCTACGATAAGCGCTTCCCGGGGTTCA
TGGCCCCGATAAGCTCGCCTGTGCCATTGTAAATACGGCCGGACGTGAGACGGGGGGAGAGCACTGGT
TGGCTTTCGGTTGGAACCCACGTTCTAACACCTGCTACCTTTTTGATCCTTTTGGATTCTCGGATGATC
GTCTCAAACAGATTTACCAGTTTGAATATGAGGGTCTCCTGCCGCAGCGCTCTTGCTACCAAGGACC
GCTGTATTACGCTGGAAAAATCTACCCAGACCGTGCAGGGTCCCGTTCTGCCGCCTGCGGACTTTTCT
GCTGCATGTTCCTTCACGCCTTTGTGCACTGGCCTGACCGTCCCATGGACGGAAACCCCACCATGAAAT
TGCTAACTGGAGTGCCAAACAACATGCTTCATTCTCCTAAAGTCCAGCCCACCCTGTGTGACAATCAAA
AAGCACTCTACCATTTTCTTAATACCCATTCGCCTTATTTTCGCTCCCATCGTACACACATCGAAAGGG
CCACTGCGTTCGACCGTATGGATGTTCAATAATGACTCATGTAAACAACGTGTTCAATAAACATCACTT
TATTTTTTACATGTATCAAGGCTCTGCATTACTTATTTATTTACAAGTCGAATGGGTTCTGACGAGAA
TCAGAATGACCCGCAGGCAGTGATACGTTGCGGAACTGATACTTGGGTTGCCACTTGAATTCGGGAATC
ACCAACTTGGGAACCGGTATATCGGGCAGGATGTCACTCCACAGCTTTCTGGTCAGCTGCAAAGCTCCA
AGCAGGTCAGGAGCCGAAATCTTGAAATCACAATTAGGACCAGTGCTTTGAGCGCGAGAGTTGCGGTAC
ACCGGATTGCAGCACTGAAACACCATCAGCGACGGATGTCTCACGCTTGCCAGCACGGTGGGATCTGCA
ATCATGCCCACATCCAGATCTTCAGCATTGGCAATGCTGAACGGGGTCATCTTGCAGGTCTGCCTACCC
ATGGCGGGCACCCAATTAGGCTTGTGGTTGCAATCGCAGTGCAGGGGATCAGTATCATCTTGGCCTGA
TCCTGTCTGATTCCTGGATACACGGCTCTCATGAAAGCATCATATTGCTTGAAAGCCTGCTGGGCTTTA
CTACCCTCGGTATAAAACATCCCGCAGGACCTGCTCGAAAACTGGTTAGCTGCACAGCCGGCATCATTC
```

Figure 66 continued

```
ACACAGCAGCGGGCGTCATTGTTAGCTATTTGCACCACACTTCTGCCCCAGCGGTTTTGGGTGATTTTG
GTTCGCTCGGGATTCTCCTTTAAGGCTCGTTGTCCGTTCTCGCTGGCCACATCCATCTCGATAATCTGC
TCCTTCTGAATCATAATATTGCCATGCAGGCACTTCAGCTTGCCCTCATAATCATTGCAGCCATGAGGC
CACAACGCACAGCCTGTACATTCCCAATTATGGTGGGCGATCTGAGAAAAAGAATGTATCATTCCCTGC
AGAAATCTTCCCATCATCGTGCTCAGTGTCTTGTGACTAGTGAAAGTTAACTGGATGCCTCGGTGCTCC
TCGTTTACGTACTGGTGACAGATGCGCTTGTATTGTTCGTGTTGCTCAGGCATTAGTTTAAAAGAGGTT
CTAAGTTCGTTATCCAGCCTGTACTTCTCCATCAGCAGACACATCACTTCCATGCCTTTCTCCCAAGCA
GACACCAGGGGCAAGCTAATCGGATTCTTAACAGTGCAGGCAGCAGCTCCTTTAGCCAGAGGGTCATCT
TTAGCGATCTTCTCAATGCTTCTTTTGCCATCCTTCTCAACGATGCGCACGGGCGGGTAGCTGAAACCC
ACTGCTACAAGTTGCGCCTCTTCTCTTTCTTCTTCGCTGTCTTGACTGATGTCTTGCATGGGGATATGT
TTGGTCTTCCTTGGCTTCTTTTGGGGGGTATCGGAGGAGGAGGACTGTCGCTCCGTTCCGGAGACAGG
GAGGATTGTGACGTTTCGCTCACCATTACCAACTGACTGTCGGTAGAAGAACCTGACCCCACACGGCGA
CAGGTGTTTCTCTTCGGGGCAGAGGTGGAGGCGATTGCGAAGGGCTGCGGTCCGACCTGGAAGGCGGA
TGACTGGCAGAACCCCTTCCGCGTTCGGGGGTGTGCTCCCTGTGGCGGTCGCTTAACTGATTTCCTTCG
CGGCTGGCCATTGTGTTCTCCTAGGCAGAGAAACAACAGACATGGAAACTCAGCCATTGCTGTCAACAT
CGCCACGAGTGCCATCACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATGACATGCAGAATAAAA
AAGCGAAAGAGTCTGAGACAGACATCGAGCAAGACCCGGGCTATGTGACACCGGTGGAACACGAGGAAG
AGTTGAAACGCTTTCTAGAGAGAGAGGATGAAAACTGCCCAAAACAACGAGCAGATAACTATCACCAAG
ATGCTGGAAATAGGGATCAGAACACCGACTACCTCATAGGGCTTGACGGGGAAGACGCGCTCCTTAAAC
ATCTAGCAAGACAGTCGCTCATAGTCAAGGATGCATTATTGGACAGAACTGAAGTGCCCATCAGTGTGG
AAGAGCTCAGCCGCGCCTACGAGCTTAACCTCTTTTCACCTCGTACTCCCCCCAAACGTCAGCCAAACG
GCACCTGCGAGCCAAATCCTCGCTTAAACTTTTATCCAGCTTTTGCTGTGCCAGAAGTACTGGCTACCT
ATCACATCTTTTTTAAAAATCAAAAAATTCCAGTCTCCTGCCGCGCTAATCGCACCCGCGCCGATGCCC
TACTCAATCTGGGACCTGGTTCACGCTTACCTGATATAGCTTCCTTGGAAGAGGTTCCAAAGATCTTCG
AGGGTCTGGGCAATAATGAGACTCGGGCCGCAAATGCTCTGCAAAAGGGAGAAAATGGCATGGATGAGC
ATCACAGCGTTCTGGTGGAATTGGAAGGCGATAATGCCAGACTCGCAGTACTCAAGCGAAGCATCGAGG
TCACACACTTCGCATATCCCGCTGTCAACCTGCCCCCTAAAGTCATGACGGCGGTCATGGACCAGTTAC
TCATTAAGCGCGCAAGTCCCCTTTCAGAAGACATGCATGACCCAGATGCCTGTGATGAGGGTAAACCAG
TGGTCAGTGATGAGCAGCTAACCCGATGGCTGGGCACCGACTCTCCCAGGGATTTGGAAGAGCGTCGCA
AGCTTATGATGGCCGTGGTGCTGGTTACCGTAGAACTAGAGTGTCTCCGACGTTTCTTTACCGATTCAG
AAACCTTGCGCAAACTCGAAGAGAATCTGCACTACACTTTTAGACACGGCTTTGTGCGGCAGGCATGCA
AGATATCTAACGTGGAACTCACCAACCTGGTTTCCTACATGGGTATTCTGCATGAGAATCGCCTAGGAC
AAAGCGTGCTGCACAGCACCCTGAAGGGGGAAGCCCGCCGTGATTACATCCGCGATTGTGTCTATCTGT
ACCTGTGCCACACGTGGCAAACCGGCATGGGTGTATGGCAGCAATGTTTAGAAGAACAGAACTTGAAAG
AGCTTGACAAGCTCTTACAGAAATCTCTTAAGGTTCTGTGGACAGGGTTCGACGAGCGCACCGTCGCTT
CCGACCTGGCAGACCTCATCTTCCCAGAGCGTCTCAGGGTTACTTTGCGAAACGGATTGCCTGACTTTA
TGAGCCAGAGCATGCTTAACAATTTTCGCTCTTTCATCCTGGAACGCTCCGGTATCCTGCCCGCCACCT
GCTGCGCACTGCCCTCCGACTTTGTGCCTCTCACCTACCGCGAGTGCCCCCGCCGCTATGGAGTCACT
GCTACCTGTTCCGTCTGGCCAACTATCTCTCCTACCACTCGGATGTGATCGAGGATGTGAGCGGAGACG
GCTTGCTGGAGTGTCACTGCCGCTGCAATCTGTGCACGCCCACCGGTCCCTAGCTTGCAACCCCCAGT
TGATGAGCGAAACCCAGATAATAGGCACCTTTGAATTGCAAGGCCCCAGCAGCCAAGGCGATGGGTCTT
CTCCTGGGCAAAGTTTAAAACTGACCCCGGGACTGTGGACCTCCGCCTACTTGCGCAAGTTTGCTCCGG
AAGATTACCACCCCTATGAAATCAAGTTCTATGAGGACCAATCACAGCCTCCAAAGGCCGAACTTTCGG
CCTGCGTCATCACCCAGGGGGCAATTCTGGCCCAATTGCAAGCCATCCAAAAATCCCGCCAAGAATTTC
TACTGAAAAAGGGTAAGGGGGTCTACCTTGACCCCCAGACCGGCGAGGAACTCAACACAAGGTTCCCTC
AGGATGTCCCAACGACGAGAAAACAAGAAGTTGAAGGTGCAGCCGCCGCCCCCAGAAGATATGGAGGAA
GATTGGGACAGTCAGGCAGAGGAGGCGGAGGAGGACAGTCTGGAGGACAGTCTGGAGGAAGACAGTTTG
GAGGAGGAAAACGAGGAGGCAGAGGAGGTGGAAGAAGTAACCGCCGACAAACAGTTATCCTCGGCTGCG
```

Figure 66 continued

```
GAGACAAGCAACAGCGCTACCATCTCCGCTCCGAGTCGAGGAACCCGGCGGCGTCCCAGCAGTAGATGG
GACGAGACCGGACGCTTCCCGAACCCAACCAGCGCTTCCAAGACCGGTAAGAAGGATCGGCAGGGATAC
AAGTCCTGGCGGGGGCATAAGAATGCCATCATCTCCTGCTTGCATGAGTGCGGGGGCAACATATCCTTC
ACGCGGCGCTACTTGCTATTCCACCATGGGGTGAACTTTCCGCGCAATGTTTTGCATTACTACCGTCAC
CTCCACAGCCCCTACTATAGCCAGCAAATCCCGGCAGTCTCGACAGATAAAGACAGCGGCGGCGACCTC
CAACAGAAACCAGCAGCGGCAGTTAGAAAATACACAACAAGTGCAGCAACAGGAGGATTAAAGATTAC
AGCCAACGAGCCAGCGCAAACCCGAGAGTTAAGAAATCGGATCTTTCCAACCCTGTATGCCATCTTCCA
GCAGAGTCGGGGTCAAGAGCAGGAACTGAAAATAAAAAACCGATCTCTGCGTTCGCTCACCAGAAGTTG
TTTGTATCACAAGAGCGAAGATCAACTTCAGCGCACTCTCGAGGACGCCGAGGCTCTCTTCAACAAGTA
CTGCGCGCTGACTCTTAAAGAGTAGGCAGCGACCGCGCTTATTCAAAAAGGCGGGAATTACATCATCC
TCGACATGAGTAAAGAAATTCCCACGCCTTACATGTGGAGTTATCAACCCCAAATGGGATTGGCGGCAG
GCGCCTCCCAGGACTACTCCACCCGCATGAATTGGCTCAGCGCCGGGCCTTCTATGATTTCTCGAGTTA
ATGATATACGCGCCTACCGAAACCAAATACTTTTGGAACAGTCAGCTCTTACCACCACGCCCCGCCAAC
ACCTTAATCCCAGAAATTGGCCCGCCGCCCTAGTGTACCAGGAAAGTCCCGCTCCCACCACTGTATTAC
TTCCTCGAGACGCCCAGGCCGAAGTCCAAATGACTAATGCAGGTGCGCAGTTAGCTGGCGGCTCCACCC
TATGTCGTCACAGGCCTCGGCATAATATAAAACGCCTGATGATCAGAGGCCGAGGTATCCAGCTCAACG
ACGAGTCGGTGAGCTCTCCGCTTGGTCTACGACCAGACGGAATCTTTCAGATTGCCGGCTGCGGGAGAT
CTTCCTTCACCCCTCGTCAGGCTGTTCTGACTTTGGAAAGTTCGTCTTCGCAACCCCGCTCGGGCGGAA
TCGGGACCGTTCAATTTGTGGAGGAGTTTACTCCCTCTGTCTACTTCAACCCCTTCTCCGGATCTCCTG
GGCATTACCCGGACGAGTTCATACCGAACTTCGACGCGATTAGCGAGTCAGTGGACGGCTACGATTGAT
GTCTGGTGACGCGGCTGAGCTATCTCGGCTGCGACATCTAGACCACTGCCGCCGCTTTCGCTGCTTTGC
CCGGGAACTCATTGAGTTCATCTACTTCGAACTCCCCAAGGATCACCCTCAAGGTCCGGCCCACGGAGT
GCGGATTTCTATCGAAGGCAAAATAGACTCTCGCCTGCAACGAATTTTCTCCCAGCGGCCCGTGCTGAT
CGAGCGAGACCAGGGAAACACCACGGTTTCCATCTACTGCATTTGTAATCACCCCGGATTGCATGAAAG
CCTTTGCTGTCTTATGTGTACTGAGTTTAATAAAAACTGAATTAAGACTCTCCTACGGACTGCCGCTTC
TTCAACCCGGATTTTACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTTCCCTACTAATACTA
CTTTCAAAACCGGAGGTGAGCTCCAAGGTCTTCCTACAGAAAACCCTTGGGTGGAAGCGGGCCTTGTAG
TGCTAGGAATTCTTGCGGGTGGGCTTGTGATTATTCTTTGCTACCTATACACACCTTGCTTCACTTTCT
TAGTGGTGTTGTGGTATTGGTTTAAAAAATGGGGCCCATACTAGTCTTGCTTGTTTTACTTTCGCTTTT
GGAACCGGGTTCTGCCAATTACGATCCATGTCTAGACTTCGACCCAGAAAACTGCACACTTACTTTTGC
ACCCGACACAAGCCGCATCTGTGGAGTTCATCGCCTCTCTTACGAACTTGGCCCCAACGACAAAAATT
TACCTGCATGGTGGGAATCAACCCCATAGTTATCACCCAGCAAAGTGGAGATACTAAGGGTTGCATTCA
CTGCTCCTGCGATTCCATCGAGTGCACCTACACCCTGCTGAAGACCCTATGCGGCCTAAGAGACCTGCT
ACCAATGAATTAAAAAATGATTAATAAAAAATCACTTACTTGAAATCAGCAATAAGGTCTCTGTTGAAA
TTTTCTCCCAGCAGCACCTCACTTCCCTCTTCCCAACTCTGGTATTCTAAACCCCGTTCAGCGGCATAC
TTTCTCCATACTTTAAAGGGGATGTCAAATTTTAGCTCCTCTCCTGTACCCACAATCTTCATGTCTTTC
TTCCCAGATGACCAAGAGAGTCCGGCTCAGTGACTCCTTCAACCCTGTCTACCCTATGAAGATGAAAG
CACCTCCCAACACCCCTTTATAAACCCAGGGTTTATTTCCCCAAATGGCTTCACACAAAGCCCAAACGG
AGTTCTTACTTTAAAATGTTTAACCCCACTAACAACCACAGGCGGATCTCTACAGCTAAAAGTGGGAGG
GGGACTTACAGTGGATGACACCAACGGTTTTTTGAAAGAAAACATAAGTGCCACCACACCACTCGTTAA
GACTGGTCACTCTATAGGTTTACCACTAGGAGCCGGATTGGGAACGAATGAAAATAAACTTTGTATCAA
ATTAGGACAAGGACTTACATTCAATTCAAACAACATTTGCATTGATGACAATATTAACACCTTATGGAC
AGGAGTCAACCCCACCGAAGCCAACTGTCAAATCATGAACTCCAGTAATCTAATGATTGCAAATTAAT
TCTAACACTAGTTAAAACTGGAGCACTAGTCACTGCATTTGTTTATGTTATAGGAGTATCTAACAATTT
TAATATGCTAACTACACACAGAAATATAAATTTTACTGCAGAGCTGTTTTTCGATTCTACTGGTAATTT
ACTAACTAGACTCTCATCCCTCAAAACTCCACTTAATCATAAATCAGGACAAAACATGGCTACTGGTGC
CATTACTAATGCTAAAGGTTTCATGCCCAGCACGACTGCCTATCCTTTCAATGATAATTCTAGAGAAAA
AGAAAACTACATTTACGGAACTTGTTACTACACAGCTAGTGATCGCACTGCTTTTCCCATTGACATATC
```

Figure 66 continued

```
TGTCATGCTTAACCGAAGAGCAATAAATGACGAGACATCATATTGTATTCGTATAACTTGGTCCTGGAA
CACAGGAGATGCCCCAGAGGTGCAAACCTCTGCTACAACCCTAGTCACCTCCCCATTTACCTTTTACTA
CATCAGAGAAGACGACTGACAAATAAAGTTTGCGATCGCCAGGCCCACCATGGGATGGAGCTGTATCAT
CCTCTTCTTGGTAGCAACAGCTACAGGTGTCCACTCCCAGGTGCAGCTGCAGCAGTCTGGGGCTGAACT
GGCAAGACCTGGGGCCTCAGTGAAGATGTCCTGCAAGGCTTCTGGCTACACCTTTACTAGGTACACGAT
GCACTGGGTAAAACAGAGGCCTGGACAGGGTCTGGAATGGATTGGATACATTAATCCTAGCCGTGGTTA
TACTAATTACAATCAGAAGTTCAAGGACAAGGCCACATTGACTACAGACAAATCCTCCAGCACAGCCTA
CATGCAACTGAGCAGCCTGACATCTGAGGACTCTGCAGTCTATTACTGTGCAAGATATTATGATGATCA
TTACTGCCTTGACTACTGGGGCCAAGGCACCACTCTCACAGTCTCCTCAGGTGGCGGTGGCTCGGGCGG
TGGTGGATCTGGTGGCGGCGGATCTGATATCGTGCTCACTCAGTCTCCAGCAATCATGTCTGCATCTCC
AGGGGAGAAGGTCACCATGACCTGCAGTGCCAGCTCAAGTGTAAGTTACATGAACTGGTACCAGCAGAA
GTCAGGCACCTCCCCCAAAAGATGGATTTATGACACATCCAAACTGGCTTCTGGAGTCCCTGCTCACTT
CAGGGGCAGTGGGTCTGGGACCTCTTACTCTCTCACAATCAGCGGCATGGAGGCTGAAGATGCTGCCAC
TTATTACTGCCAGCAGTGGAGTAGTAACCCATTCACGTTCGGCTCGGGGACAAAGTTGGAAATAAACCG
GGGATCCGAACAAAACTCATCTCAGAAGAGGATCTGAATGCTGTGGGCCAGGACACGCAGGAGGTCAT
CGTGGTGCCACACTCCTTGCCCTTTAAGGTGGTGGTGATCTCAGCCATCCTGGCCCTGGTGGTGCTCAC
CATCATCTCCCTTATCATCCTCATCATGCTTTGGCAGAAGAAGCCACGTTAAGCTAGCTTGACTGACTG
AGATACAGCGTACCTTCAGCTCACAGACATGATAAGATACATTGATGAGTTTGGACAAACCACAACTAG
AATGCAGTGAAAAAATGCTTTATTTGTGAAATTTGTGATGCTATTGCTTTATTTGTAACCATTATAAG
CTGCAATAAACAAGTTAACAACAACAATTGCATTCATTTTATGTTTCAGGTTCAGGGGGAGGTGTGGGA
GGTTTTTTAAAGCAAGTAAAACCTCTACAAATGTGGTAGTCGTCAGCTATCCTGCAGGAACTTGTTTAT
TTGAAAATCAATTCACAAAATCCGAGTAGTTATTTTGCCTCCCCCTTCCCATTTAACAGAATACACCAA
TCTCTCCCCACGCACAGCTTTAAACATTTGGATACCATTAGATATAGACATGGTTTTAGATTCCACATT
CCAAACAGTTTCAGAGCGAGCCAATCTGGGGTCAGTGATAGATAAAAATCCATCGGGATAGTCTTTTAA
AGCGCTTTCACAGTCCAACTGCTGCGGATGCGACTCCGGAGTCTGGATCACGGTCATCTGGAAGAAGAA
CGATGGGAATCATAATCCGAAAACGGTATCGGACGATTGTGTCTCATCAAACCCACAAGCAGCCGCTGT
CTGCGTCGCTCCGTGCGACTGCTGTTTATGGGATCAGGGTCCACAGTGTCCTGAAGCATGATTTTAATA
GCCCTTAACATCAACTTTCTGGTGCGATGCGCGCAGCAACGCATTCTGATTTCACTCAAATCTTTGCAG
TAGGTACAACACATTATTACAATATTGTTTAATAAACCATAATTAAAAGCGCTCCAGCCAAAACTCATA
TCTGATATAATCGCCCCTGCATGACCATCATACCAAAGTTTAATATAAATTAAATGACGTTCCCTCAAA
AACACACTACCCACATACATGATCTCTTTTGGCATGTGCATATTAACAATCTGTCTGTACCATGGACAA
CGTTGGTTAATCATGCAACCCAATATAACCTTCCGGAACCACACTGCCAACACCGCTCCCCAGCCATG
CATTGAAGTGAACCCTGCTGATTACAATGACAATGAAGAACCCAATTCTCTCGACCGTGAATCACTTGA
GAATGAAAAATATCTATAGTGGCACAACATAGACATAAATGCATGCATCTTCTCATAATTTTTAACTCC
TCAGGATTTAGAAACATATCCCAGGGAATAGGAAGCTCTTGCAGAACAGTAAAGCTGGCAGAACAAGGA
AGACCACGAACACAACTTACACTATGCATAGTCATAGTATCACAATCTGGCAACAGCGGGTGGTCTTCA
GTCATAGAAGCTCGGGTTTCATTTTCCTCACAACGTGGTAACTGGGCTCTGGTGTAAGGGTGATGTCTG
GCGCATGATGTCGAGCGTGCGCGCAACCTTGTCATAATGGAGTTGCTTCCTGACATTCTCGTATTTTGT
ATAGCAAAACGCGGCCCTGGCAGAACACACTCTTCTTCGCCTTCTATCCTGCCGCTTAGCGTGTTCCGT
GTGATAGTTCAAGTACAACCACACTCTTAAGTTGGTCAAAAGAATGCTGGCTTCAGTTGTAATCAAAAC
TCCATCGCATCTAATCGTTCTGAGGAAATCATCCAAGCAATGCAACTGGATTGTGTTTCAAGCAGGAGA
GGAGAGGGAAGAGACGGAAGAACCATGTTAATTTTTATTCCAAACGATCTCGCAGTACTTCAAATTGTA
GATCGCGCAGATGGCATCTCTCGCCCCCACTGTGTTGGTGAAAAGCACAGCTAGATCAAAAGAAATGC
GATTTTCAAGGTGCTCAACGGTGGCTTCAGCAAAGCCTCCACGCGCACATCCAAGAACAAAGAATAC
CAAAAGAAGGAGCATTTTCTAACTCCTCAATCATCATATTACATTCCTGCACCATTCCCAGATAATTTT
CAGCTTTCCAGCCTTGAATTATTCGTGTCAGTTCTTGTGGTAAATCCAATCCACACATTACAAACAGGT
CCCGGAGGGCGCCCTCCACCACCATTCTTAAACACACCCTCATAATGACAAAATATCTTGCTCCTGTGT
CACCTGTAGCGAATTGAGAATGGCAACATCAATTGACATGCCCTTGGCTCTAAGTTCTTCTTTAAGTTC
TAGTTGTAAAAACTCTCTCATATTATCACCAAACTGCTTAGCCAGAAGCCCCCGGGAACAAGAGCAGG
```

Figure 66 continued

GGACGCTACAGTGCAGTACAAGCGCAGACCTCCCCAATTGGCTCCAGCAAAAACAAGATTGGAATAAGC
ATATTGGGAACCGCCAGTAATATCATCGAAGTTGCTGGAAATATAATCAGGCAGAGTTTCTTGTAAAAA
TTGAATAAAAGAAAAATTTGCCAAAAAAACATTCAAAACCTCTGGGATGCAAATGCAATAGGTTACCGC
GCTGCGCTCCAACATTGTTAGTTTTGAATTAGTCTGCAAAATAAAAAAAAAAACAAGCGTCATATCAT
AGTAGCCTGACGAACAGATGGATAAATCAGTCTTTCCATCACAAGACAAGCCACAGGGTCTCCAGCTCG
ACCCTCGTAAAACCTGTCATCATGATTAAACAACAGCACCGAAAGTTCCTCGCGGTGACCAGCATGAAT
AATTCTTGATGAAGCATACAATCCAGACATGTTAGCATCAGTTAACGAGAAAAAACAGCCAACATAGCC
TTTGGGTATAATTATGCTTAATCGTAAGTATAGCAAAGCCACCCCTCGCGGATACAAAGTAAAAGGCAC
AGGAGAATAAAAAATATAATTATTTCTCTGCTGCTGTTCAGGCAACGTCGCCCCGGTCCCTCTAAATA
CACATACAAAGCCTCATCAGCCATGGCTTACCAGACAAAGTACAGCGGGCACACAAAGCACAAGCTCTA
AAGTGACTCTCCAACCTCTCCACAATATATATATACACAAGCCCTAAACTGACGTAATGGGAGTAAAGT
GTAAAAAATCCCGCCAAACCCAACACACACCCCGAAACTGCGTCACCAGGGAAAAGTACAGTTTCACTT
CCGCAATCCCAACAGGCGTAACTTCCTCTTTCTCACGGTACGTGATATCCCACTAACTTGCAACGTCAT
TTTCCCACGGTCGCACCGCCCCTTTTAGCCGTTAACCCCACAGCCAATCACCACACGATCCACACTTTT
TAAAATCACCTCATTTACATATTGGCACCATTCCATCTATAAGGTATATTATATAGATAGA

Figure 67
SEQ ID NO. 104 NG-420A virus genome sequence comprising the EnAd genome with a transgene cassette that encodes a membrane-anchored chimeric form of the single chain Fv anti-human CD3e and a C-terminal V5 tag, inserted in the region Bγ. The transgene cassette contains a 5' SSA, membrane-anchored anti-CD3ε cDNA sequence, V5 tag sequence and a 3' poly(A) sequence.

TCTATCTATATAATATACCTTATAGATGGAATGGTGCCAATATGTAAATGAGGTGATTTAAAAAGTGT
GGATCGTGTGGTGATTGGCTGTGGGGTTAACGGCTAAAAGGGGCGGTGCGACCGTGGGAAAATGACGTT
TTGTGGGGGTGGAGTTTTTTTGCAAGTTGTCGCGGGAAATGTGACGCATAAAAAGGCTTTTTTCTCACG
GAACTACTTAGTTTTCCCACGGTATTTAACAGGAAATGAGGTAGTTTTGACCGGATGCAAGTGAAAATT
GTTGATTTTCGCGCGAAAACTGAATGAGGAAGTGTTTTTCTGAATAATGTGGTATTTATGGCAGGGTGG
AGTATTTGTTCAGGGCCAGGTAGACTTTGACCCATTACGTGGAGGTTTCGATTACCGTGTTTTTTACCT
GAATTTCCGCGTACCGTGTCAAAGTCTTCTGTTTTACGTAGGTGTCAGCTGATCGCTAGGGTATTTAT
ACCTCAGGGTTTGTGTCAAGAGGCCACTCTTGAGTGCCAGCGAGAAGAGTTTTCTCCTCTGCGCCGGCA
GTTTAATAATAAAAAAATGAGAGATTTGCGATTTCTGCCTCAGGAAATAATCTCTGCTGAGACTGGAAA
TGAAATATTGGAGCTTGTGGTGCACGCCCTGATGGGAGACGATCCGGAGCCACCTGTGCAGCTTTTTGA
GCCTCCTACGCTTCAGGAACTGTATGATTTAGAGGTAGAGGGATCGGAGGATTCTAATGAGGAAGCTGT
AAATGGCTTTTTTACCGATTCTATGCTTTTAGCTGCTAATGAAGGGTTAGAATTAGATCCGCCTTTGGA
CACTTTTGATACTCCAGGGGTAATTGTGGAAAGCGGTACAGGTGTAAGAAAATTACCTGATTTGAGTTC
CGTGGACTGTGATTTGCACTGCTATGAAGACGGGTTTCCTCCGAGTGATGAGGAGGACCATGAAAAGGA
GCAGTCCATGCAGACTGCAGCGGGTGAGGGAGTGAAGGCTGCCAATGTTGGTTTTCAGTTGGATTGCCC
GGAGCTTCCTGGACATGGCTGTAAGTCTTGTGAATTTCACAGGAAAAATACTGGAGTAAAGGAACTGTT
ATGTTCGCTTTGTTATATGAGAACGCACTGCCACTTTATTTACAGTAAGTGTGTTTAAGTTAAAATTTA
AAGGAATATGCTGTTTTTCACATGTATATTGAGTGTGAGTTTTGTGCTTCTTATTATAGGTCCTGTGTC
TGATGCTGATGAATCACCATCTCCTGATTCTACTACCTCACCTCCTGAGATTCAAGCACCTGTTCCTGT
GGACGTGCGCAAGCCCATTCCTGTGAAGCTTAAGCCTGGGAAACGTCCAGCAGTGGAAAACTTGAGGA
CTTGTTACAGGGTGGGGACGGACCTTTGGACTTGAGTACACGGAAACGTCCAAGACAATAAGTGTTCCA
TATCCGTGTTTACTTAAGGTGACGTCAATATTTGTGTGACAGTGCAATGTAATAAAAATATGTTAACTG
TTCACTGGTTTTTATTGCTTTTGGGCGGGGACTCAGGTATATAAGTAGAAGCAGACCTGTGTGGTTAG
CTCATAGGAGCTGGCTTTCATCCATGGAGGTTTGGGCCATTTTGGAAGACCTTAGGAAGACTAGGCAAC
TGTTAGAGAACGCTTCGGACGGAGTCTCCGGTTTTTGGAGATTCTGGTTCGCTAGTGAATTAGCTAGGG
TAGTTTTTAGGATAAAACAGGACTATAAACAAGAATTTGAAAAGTTGTTGGTAGATTGCCCAGGACTTT
TTGAAGCTCTTAATTTGGGCCATCAGGTTCACTTTAAAGAAAAAGTTTTATCAGTTTTAGACTTTTCAA

Figure 67 continued

```
CCCCAGGTAGAACTGCTGCTGCTGTGGCTTTTCTTACTTTTATATTAGATAAATGGATCCCGCAGACTC
ATTTCAGCAGGGGATACGTTTTGGATTTCATAGCCACAGCATTGTGGAGAACATGGAAGGTTCGCAAGA
TGAGGACAATCTTAGGTTACTGGCCAGTGCAGCCTTTGGGTGTAGCGGGAATCCTGAGGCATCCACCGG
TCATGCCAGCGGTTCTGGAGGAGGAACAGCAAGAGGACAACCCGAGAGCCGGCCTGGACCCTCCAGTGG
AGGAGGCGGAGTAGCTGACTTGTCTCCTGAACTGCAACGGGTGCTTACTGGATCTACGTCCACTGGACG
GGATAGGGGCGTTAAGAGGGAGAGGGCATCTAGTGGTACTGATGCTAGATCTGAGTTGGCTTTAAGTTT
AATGAGTCGCAGACGTCCTGAAACCATTTGGTGGCATGAGGTTCAGAAAGAGGGAAGGGATGAAGTTTC
TGTATTGCAGGAGAAATATTCACTGGAACAGGTGAAAACATGTTGGTTGGAGCCTGAGGATGATTGGGA
GGTGGCCATTAAAAATTATGCCAAGATAGCTTTGAGGCCTGATAAACAGTATAAGATTACTAGACGGAT
TAATATCCGGAATGCTTGTTACATATCTGGAAATGGGGCTGAGGTGGTAATAGATACTCAAGACAAGGC
AGTTATTAGATGCTGCATGATGGATATGTGGCCTGGGGTAGTCGGTATGAAGCAGTAACTTTTGTAAA
TGTTAAGTTTAGGGGAGATGGTTATAATGGAATAGTGTTTATGGCCAATACCAAACTTATATTGCATGG
TTGTAGCTTTTTGGTTTCAACAATACCTGTGTAGATGCCTGGGGACAGGTTAGTGTACGGGGATGTAG
TTTCTATGCGTGTTGGATTGCCACAGCTGGCAGAACCAAGAGTCAATTGTCTCTGAAGAAATGCATATT
TCAAAGATGTAACCTGGGCATTCTGAATGAAGGCGAAGCAAGGGTCCGCCACTGCGCTTCTACAGATAC
TGGATGTTTTATTTTGATTAAGGGAAATGCCAGCGTAAAGCATAACATGATTTGCGGTGCTTCCGATGA
GAGGCCTTATCAAATGCTCACTTGTGCTGGTGGGCATTGTAATATGCTGGCTACTGTGCATATTGTTTC
CCATCAACGCAAAAAATGGCCTGTTTTGATCACAATGTGATGACGAAGTGTACCATGCATGCAGGTGG
GCGTAGAGGAATGTTTATGCCTTACCAGTGTAACATGAATCATGTGAAAGTGTTGTTGGAACCAGATGC
CTTTTCCAGAATGAGCCTAACAGGAATTTTTGACATGAACATGCAAATCTGGAAGATCCTGAGGTATGA
TGATACGAGATCGAGGGTACGCGCATGCGAATGCGGAGGCAAGCATGCCAGGTTCCAGCCGGTGTGTGT
AGATGTGACTGAAGATCTCAGACCGGATCATTTGGTTATTGCCCGCACTGGAGCAGAGTTCGGATCCAG
TGGAGAAGAAACTGACTAAGGTGAGTATTGGGAAAACTTTGGGGTGGGATTTTCAGATGGACAGATTGA
GTAAAAATTTGTTTTTCTGTCTTGCAGCTGTCATGAGTGGAAACGCTTCTTTTAAGGGGGGAGTCTTC
AGCCCTTATCTGACAGGGCGTCTCCCATCCTGGGCAGGAGTTCGTCAGAATGTTATGGGATCTACTGTG
GATGGAAGACCCGTCCAACCCGCCAATTCTTCAACGCTGACCTATGCTACTTTAAGTTCTTCACCTTTG
GACGCAGCTGCAGCTGCCGCCGCCGCTTCTGTTGCCGCTAACACTGTGCTTGGAATGGGTTACTATGGA
AGCATCATGGCTAATTCCACTTCCTCTAATAACCCTTCTACCCTGACTCAGGACAAGTTACTTGTCCTT
TTGGCCCAGCTGGAGGCTTTGACCCAACGTCTGGGTGAACTTTCTCAGCAGGTGGTCGAGTTGCGAGTA
CAAACTGAGTCTGCTGTCGGCACGGCAAAGTCTAAATAAAAAAATCCCAGAATCAATGAATAAATAAAC
AAGCTTGTTGTTGATTTAAAATCAAGTGTTTTTATTTCATTTTTCGCGCACGGTATGCCCTAGACCACC
GATCTCTATCATTGAGAACTCGGTGGATTTTTTCCAGGATCCTATAGAGGTGGGATTGAATGTTTAGAT
ACATGGGCATTAGGCCGTCTTTGGGGTGGAGATAGCTCCATTGAAGGGATTCATGCTCCGGGGTAGTGT
TGTAAATCACCCAGTCATAACAAGGTCGCAGTGCATGGTGTTGCACAATATCTTTTAGAAGTAGGCTGA
TTGCCACAGATAAGCCCTTGGTGTAGGTGTTTACAAACCGGTTGAGCTGGGATGGGTGCATTCGGGGTG
AAATTATGTGCATTTTGGATTGGATTTTTAAGTTGGCAATATTGCCGCCAAGATCCCGTCTTGGGTTCA
TGTTATGAAGGACCACCAAGACGGTGTATCCGGTACATTTAGGAAATTTATCGTGCAGCTTGGATGGAA
AAGCGTGGAAAAATTTGGAGACACCCTTGTGTCCTCCAAGATTTTCCATGCACTCATCCATGATAATAG
CAATGGGGCCGTGGGCAGCGGCGCGGGCAAACACGTTCCGTGGGTCTGACACATCATAGTTATGTTCCT
GAGTTAAATCATCATAAGCCATTTTAATGAATTTGGGGCGGAGAGTACCAGATTGGGGTATGAATGTTC
CTTCGGGCCCCGGAGCATAGTTCCCCTCACAGATTTGCATTTCCCAAGCTTTCAGTTCCGAGGGTGGAA
TCATGTCCACCTGGGGGGCTATGAAAACACCGTTTCTGGGGCGGGGTGATTAATTGTGATGATAGCA
AATTTCTGAGCAATTGAGATTTGCCACATCCGGTGGGGCCATAAATGATTCCGATTACGGGTTGCAGGT
GGTAGTTTAGGGAACGGCAACTGCCGTCTTCTCGAAGCAAGGGGCCACCTCGTTCATCATTTCCCTTA
CATGCATATTTTCCCGCACCAAATCCATTAGGAGGCGCTCTCCTCCTAGTGATAGAAGTTCTTGTAGTG
AGGAAAAGTTTTTCAGCGGTTTCAGACCGTCAGCCATGGGCATTTTGGAGAGAGTTTGCTGCAAAAGTT
CTAGTCTGTTCCACAGTTCAGTGATGTGTTCTATGGCATCTCGATCCAGCAGACCTCCTCGTTTCGCGG
GTTTGGACGGCTCCTGGAATAGGGTATGAGACGATGGGCGTCCAGCGCTGCCAGGGTTCGGTCCTTCCA
GGGTCTCAGTGTTCGAGTCAGGGTTGTTTCCGTCACAGTGAAGGGGTGTGCGCCTGCTTGGGCGCTTGC
```

Figure 67 continued

```
CAGGGTGCGCTTCAGACTCATCCTGCTGGTCGAAAACTTCTGTCGCTTGGCGCCCTGTATGTCGGCCAA
GTAGCAGTTTACCATGAGTTCGTAGTTGAGCGCCTCGGCTGCGTGGCCTTTGGCGCGGAGCTTACCTTT
GGAAGTTTTCTTGCATACCGGGCAGTATAGGCATTTCAGCGCATACAACTTGGGCGCAAGGAAAACGGA
TTCTGGGGAGTATGCATCTGCGCCGCAGGAGGCGCAAACAGTTTCACATTCCACCAGCCAGGTTAAATC
CGGTTCATTGGGGTCAAAAACAAGTTTTCCGCCATATTTTTGATGCGTTTCTTACCTTTGGTCTCCAT
GAGTTCGTGTCCTCGTTGAGTGACAAACAGGCTGTCCGTGTCCCCGTAGACTGATTTTACAGGCCTCTT
CTCCAGTGGAGTGCCTCGGTCTTCTTCGTACAGGAACTCTGACCACTCTGATACAAAGGCGCGCGTCCA
GGCCAGCACAAAGGAGGCTATGTGGGAGGGGTAGCGATCGTTGTCAACCAGGGGGTCCACCTTTTCCAA
AGTATGCAAACACATGTCACCCTCTTCAACATCCAGGAATGTGATTGGCTTGTAGGTGTATTTCACGTG
ACCTGGGGTCCCCGCTGGGGGGGTATAAAAGGGGGCGGTTCTTTGCTCTTCCTCACTGTCTTCCGGATC
GCTGTCCAGGAACGTCAGCTGTTGGGGTAGGTATTCCCTCTCGAAGGCGGGCATGACCTCTGCACTCAG
GTTGTCAGTTTCTAAGAACGAGGAGGATTTGATATTGACAGTGCCGGTTGAGATGCCTTTCATGAGGTT
TTCGTCCATCTGGTCAGAAAACACAATTTTTTATTGTCAAGTTTGGTGGCAAATGATCCATACAGGGC
GTTGGATAAAAGTTTGGCAATGGATCGCATGGTTTGGTTCTTTTCCTTGTCCGCGCGCTCTTTGGCGGC
GATGTTGAGTTGGACATACTCGCGTGCCAGGCACTTCCATTCGGGGAAGATAGTTGTTAATTCATCTGG
CACGATTCTCACTTGCCACCCTCGATTATGCAAGGTAATTAAATCCACACTGGTGGCCACCTCGCCTCG
AAGGGGTTCATTGGTCCAACAGAGCCTACCTCCTTTCCTAGAACAGAAAGGGGGAAGTGGGTCTAGCAT
AAGTTCATCGGGAGGGTCTGCATCCATGGTAAAGATTCCCGGAAGTAAATCCTTATCAAAATAGCTGAT
GGGAGTGGGGTCATCTAAGGCCATTTGCCATTCTCGAGCTGCCAGTGCGCGCTCATATGGGTTAAGGGG
ACTGCCCCATGGCATGGGATGGGTGAGTGCAGAGGCATACATGCCACAGATGTCATAGACGTAGATGGG
ATCCTCAAAGATGCCTATGTAGGTTGGATAGCATCGCCCCCCTCTGATACTTGCTCGCACATAGTCATA
TAGTTCATGTGATGGCGCTAGCAGCCCCGGACCCAAGTTGGTGCGATTGGGTTTTTCTGTTCTGTAGAC
GATCTGGCGAAAGATGGCGTGAGAATTGGAAGAGATGGTGGGTCTTTGAAAAATGTTGAAATGGGCATG
AGGTAGACCTACAGAGTCTCTGACAAAGTGGGCATAAGATTCTTGAAGCTTGGTTACCAGTTCGGCGGT
GACAAGTACGTCTAGGGCGCAGTAGTCAAGTGTTTCTTGAATGATGTCATAACCTGGTTGGTTTTTCTT
TTCCCACAGTTCGCGGTTGAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGGCAGCAGCCCTTCTC
TACGGGTAGAGAGTATGCTTGAGCAGCTTTTCGTAGCGAAGCGTGAGTAAGGGCAAAGGTGTCTCTGAC
CATGACTTTGAGGAATTGGTATTTGAAGTCGATGTCGTCACAGGCTCCCTGTTCCCAGAGTTGGAAGTC
TACCCGTTTCTTGTAGGCGGGGTTGGGCAAAGCGAAAGTAACATCATTGAAGAGAATCTTGCCGGCCCT
GGGCATGAAATTGCGAGTGATGCGAAAAGGCTGTGGTACTTCCGCTCGGTTATTGATAACCTGGGCAGC
TAGGACGATCTCGTCGAAACCGTTGATGTTGTGTCCTACGATGTATAATTCTATGAAACGCGGCGTGCC
TCTGACGTGAGGTAGCTTACTGAGCTCATCAAAGGTTAGGTCTGTGGGGTCAGATAAGGCGTAGTGTTC
GAGAGCCCATTCGTGCAGGTGAGGATTCGCTTTAAGGAAGGAGGACCAGAGGTCCACTGCCAGTGCTGT
TTGTAACTGGTCCCGGTACTGACGAAAATGCCGTCCGACTGCCATTTTTCTGGGGTGACGCAATAGAA
GGTTTGGGGTCCTGCCGCCAGCGATCCCACTTGAGTTTTATGGCGAGGTCATAGGCGATGTTGACGAG
CCGCTGGTCTCCAGAGAGTTTCATGACCAGCATGAAGGGGATTAGCTGCTTGCCAAAGGACCCCATCCA
GGTGTAGGTTTCCACATCGTAGGTGAGAAAGAGCCTTTCTGTGCGAGGATGAGAGCCAATCGGGAAGAA
CTGGATCTCCTGCCACCAGTTGGAGGAATGGCTGTTGATGTGATGGAAGTAGAACTCCCTGCGACGCGC
CGAGCATTCATGCTTGTGCTTGTACAGACGGCCGCAGTAGTCGCAGCGTTGCACGGGTTGTATCTCGTG
AATGAGTTGTACCTGGCTTCCCTTGACGAGAAATTTCAGTGGGAAGCCGAGGCCTGGCGATTGTATCTC
GTGCTTTACTATGTTGTCTGCATCGGCCTGTTCATCTTCTGTCTCGATGGTGGTCATGCTGACGAGCCC
TCGCGGGAGGCAAGTCCAGACCTCGGCGCGGCAGGGCGGAGCTCGAGGACGAGAGCGCGCAGGCTGGA
GCTGTCCAGGGTCCTGAGACGCTGCGGACTCAGGTTAGTAGGCAGTGTCAGGAGATTAACTTGCATGAT
CTTTTGGAGGGCGTGCGGGAGGTTCAGATAGTACTTGATCTCAACGGGTCCGTTGGTGGAGATGTCGAT
GGCTTGCAGGGTTCCGTGTCCCTTGGGCGCTACCACCGTGCCCTTGTTTTTCATTTTGGACGGCGGTGG
CTCTGTTGCTTCTTGCATGTTTAGAAGCGGTGTCGAGGGCGCGCACCGGGCGGCAGGGGCGGCTCGGGA
CCCGGCGGCATGGCTGGCAGTGGTACGTCGGCGCCGCGCGGGTAGGTTCTGGTACTGCGCCCTGAGA
AGACTCGCATGCGCGACGACGCGGCGGTTGACATCCTGGATCTGACGCCTCTGGGTGAAAGCTACCGGC
```

Figure 67 continued

```
CCCGTGAGCTTGAACCTGAAAGAGAGTTCAACAGAATCAATCTCGGTATCGTTGACGGCGGCTTGCCTA
AGGATTTCTTGCACGTCACCAGAGTTGTCCTGGTAGGCGATCTCCGCCATGAACTGCTCGATCTCTTCC
TCTTGAAGATCTCCGCGGCCCGCTCTCTCGACGGTGGCCGCGAGGTCGTTGGAGATGCGCCCAATGAGT
TGAGAGAATGCATTCATGCCCGCCTCGTTCCAGACGCGGCTGTAGACCACGGCCCCACGGGATCTCTC
GCGCGCATGACCACCTGGGCGAGGTTGAGCTCCACGTGGCGGGTGAAGACCGCATAGTTGCATAGGCGC
TGGAAAAGGTAGTTGAGTGTGGTGGCGATGTGCTCGGTGACGAAGAAATACATGATCCATCGTCTCAGC
GGCATCTCGCTGACATCGCCCAGAGCTTCCAAGCGCTCCATGGCCTCGTAGAAGTCCACGGCAAAATTA
AAAAACTGGAGTTTCGCGCGGACACGGTCAACTCCTCTTCCAGAAGACGGATAAGTTCGGCGATGGTG
GTGCGCACCTCGCGCTCGAAAGCCCCTGGGATTTCTTCCTCAATCTCTTCTTCTTCCACTAACATCTCT
TCCTCTTCAGGTGGGGCTGCAGGAGGAGGGGAACGCGGCGACGCCGGCGGCGCACGGGCAGACGGTCG
ATGAATCTTTCAATGACCTCTCCGCGGCGGCGGCGCATGGTTTCAGTGACGGCGCGGCCGTTCTCGCGC
GGTCGCAGAGTAAAAACACCGCCGCGCATCTCCTTAAAGTGGTGACTGGGAGGTTCTCCGTTTGGGAGG
GAGAGGGCGCTGATTATACATTTTATTAATTGGCCCGTAGGGACTGCACGCAGAGATCTGATCGTGTCA
AGATCCACGGGATCTGAAAACCTTTCGACGAAAGCGTCTAACCAGTCACAGTCACAAGGTAGGCTGAGT
ACGGCTTCTTGTGGGCGGGGGTGGTTATGTGTTCGGTCTGGGTCTTCTGTTTCTTCTTCATCTCGGGAA
GGTGAGACGATGCTGCTGGTGATGAAATTAAAGTAGGCAGTTCTAAGACGGCGGATGGTGGCGAGGAGC
ACCAGGTCTTTGGGTCCGGCTTGCTGGATACGCAGGCGATTGGCCATTCCCCAAGCATTATCCTGACAT
CTAGCAAGATCTTTGTAGTAGTCTTGCATGAGCCGTTCTACGGGCACTTCTTCCTCACCCGTTCTGCCA
TGCATACGTGTGAGTCCAAATCCGCGCATTGGTTGTACCAGTGCCAAGTCAGCTACGACTCTTTCGGCG
AGGATGGCTTGCTGTACTTGGGTAAGGGTGGCTTGAAAGTCATCAAAATCCACAAAGCGGTGGTAAGCT
CCTGTATTAATGGTGTAAGCACAGTTGGCCATGACTGACCAGTTAACTGTCTGGTGACCAGGGCGCACG
AGCTCGGTGTATTTAAGGCGCGAATAGGCGCGGGTGTCAAAGATGTAATCGTTGCAGGTGCGCACCAGA
TACTGGTACCCTATAAGAAAATGCGGCGGTGGTTGGCGGTAGAGAGGCCATCGTTCTGTAGCTGGAGCG
CCAGGGGCGAGGTCTTCCAACATAAGGCGGTGATAGCCGTAGATGTACCTGGACATCCAGGTGATTCCT
GCGGCGGTAGTAGAAGCCCGAGGAAACTCGCGTACGCGGTTCCAAATGTTGCGTAGCGGCATGAAGTAG
TTCATTGTAGGCACGGTTTGACCAGTGAGGCGCGCGCAGTCATTGATGCTCTATAGACACGGAGAAAAT
GAAAGCGTTCAGCGACTCGACTCCGTAGCCTGGAGGAACGTGAACGGGTTGGGTCGCGGTGTACCCCGG
TTCGAGACTTGTACTCGAGCCGGCCGGAGCCGCGGCTAACGTGGTATTGGCACTCCCGTCTCGACCCAG
CCTACAAAAATCCAGGATACGGAATCGAGTCGTTTGCTGGTTTCCGAATGGCAGGGAAGTGAGTCCTA
TTTTTTTTTTTGCCGCTCAGATGCATCCCGTGCTGCGACAGATGCGCCCCAACAACAGCCCCCCTCG
CAGCAGCAGCAGCAGCAATCACAAAAGGCTGTCCCTGCAACTACTGCAACTGCCGCCGTGAGCGGTGCG
GGACAGCCCGCCTATGATCTGGACTTGGAAGAGGGCGAAGGACTGGCACGTCTAGGTGCGCCTTCACCC
GAGCGGCATCCGCGAGTTCAACTGAAAAAGATTCTCGCGAGGCGTATGTGCCCAACAGAACCTATTT
AGAGACAGAAGCGGCGAGGAGCCGGAGGAGATGCGAGCTTCCCGCTTTAACGCGGGTCGTGAGCTGCGT
CACGGTTTGGACCGAAGACGAGTGTTGCGGGACGAGGATTTCGAAGTTGATGAAATGACAGGGATCAGT
CCTGCCAGGGCACACGTGGCTGCAGCCAACCTTGTATCGGCTTACGAGCAGACAGTAAAGGAAGAGCGT
AACTTCCAAAAGTCTTTTAATAATCATGTGCGAACCCTGATTGCCCGCGAAGAAGTTACCCTTGGTTTG
ATGCATTTGTGGGATTTGATGGAAGCTATCATTCAGAACCCTACTAGCAAACCTCTGACCGCCCAGCTG
TTTCTGGTGGTGCAACACAGCAGAGACAATGAGGCTTTCAGAGAGGCGCTGCTGAACATCACCGAACCC
GAGGGGAGATGGTTGTATGATCTTATCAACATTCTACAGAGTATCATAGTGCAGGAGCGGAGCCTGGGC
CTGGCCGAGAAGGTGGCTGCCATCAATTACTCGGTTTTGAGCTTGGGAAAATATTACGCTCGCAAAATC
TACAAGACTCCATACGTTCCCATAGACAAGGAGGTGAAGATAGATGGGTTCTACATGCGCATGACGCTC
AAGGTCTTGACCCTGAGCGATGATCTTGGGGTGTATCGCAATGACAGAATGCATCGCGCGGTTAGCGCC
AGCAGGAGGCGCGAGTTAAGCGACAGGGAACTGATGCACAGTTTGCAAAGAGCTCTGACTGGAGCTGGA
ACCGAGGGTGAGAATTACTTCGACATGGGAGCTGACTTGCAGTGGCAGCCTAGTCGCAGGGCTCTGAGC
GCCGCGACGGCAGGATGTGAGCTTCCTTACATAGAAGAGGCGGATGAAGGCGAGGAGGAAGAGGGCGAG
TACTTGGAAGACTGATGGCACAACCCGTGTTTTTGCTAGATGGAACAGCAAGCACCGGATCCCGCAAT
GCGGCGGCGCTGCAGAGCCAGCCGTCCGGCATTAACTCCTCGGACGATTGGACCCAGGCCATGCAACG
TATCATGGCGTTGACGACTCGCAACCCCGAAGCCTTTAGACAGCAACCCCAGGCCAACCGTCTATCGGC
```

Figure 67 continued

```
CATCATGGAAGCTGTAGTGCCTTCCCGCTCTAATCCCACTCATGAGAAGGTCCTGGCCATCGTGAACGC
GTTGGTGGAGAACAAAGCTATTCGTCCAGATGAGGCCGGACTGGTATACAACGCTCTCTTAGAACGCGT
GGCTCGCTACAACAGTAGCAATGTGCAAACCAATTTGGACCGTATGATAACAGATGTACGCGAAGCCGT
GTCTCAGCGCGAAAGGTTCCAGCGTGATGCCAACCTGGGTTCGCTGGTGGCGTTAAATGCTTTCTTGAG
TACTCAGCCTGCTAATGTGCCGCGTGGTCAACAGGATTATACTAACTTTTTAAGTGCTTTGAGACTGAT
GGTATCAGAAGTACCTCAGAGCGAAGTGTATCAGTCCGGTCCTGATTACTTCTTTCAGACTAGCAGACA
GGGCTTGCAGACGGTAAATCTGAGCCAAGCTTTTAAAAACCTTAAAGGTTTGTGGGGAGTGCATGCCCC
GGTAGGAGAAAGAGCAACCGTGTCTAGCTTGTTAACTCCGAACTCCCGCCTATTATTACTGTTGGTAGC
TCCTTTCACCGACAGCGGTAGCATCGACCGTAATTCCTATTTGGGTTACCTACTAAACCTGTATCGCGA
AGCCATAGGGCAAAGTCAGGTGGACGAGCAGACCTATCAAGAAATTACCCAAGTCAGTCGCGCTTTGGG
ACAGGAAGACACTGGCAGTTTGGAAGCCACTCTGAACTTCTTGCTTACCAATCGGTCTCAAAAGATCCC
TCCTCAATATGCTCTTACTGCGGAGGAGGAGAGGATCCTTAGATATGTGCAGCAGAGCGTGGGATTGTT
TCTGATGCAAGAGGGGCAACTCCGACTGCAGCACTGGACATGACAGCGCGAAATATGGAGCCCAGCAT
GTATGCCAGTAACCGACCTTTCATTAACAAACTGCTGGACTACTTGCACAGAGCTGCCGCTATGAACTC
TGATTATTTCACCAATGCCATCTTAAACCCGCACTGGCTGCCCCCACCTGGTTTCTACACGGGCAATA
TGACATGCCCGACCCTAATGACGGATTTCTGTGGGACGACGTGGACAGCGATGTTTTTCACCTCTTTC
TGATCATCGCACGTGGAAAAAGGAAGGCGGCGATAGAATGCATTCTTCTGCATCGCTGTCCGGGGTCAT
GGGTGCTACCGCGGCTGAGCCCGAGTCTGCAAGTCCTTTTCCTAGTCTACCCTTTTCTCTACACAGTGT
ACGTAGCAGCGAAGTGGGTAGAATAAGTCGCCCGAGTTTAATGGGCGAAGAGGAGTATCTAAACGATTC
CTTGCTCAGACCGGCAAGAGAAAAAAATTTCCCAAACAATGGAATAGAAAGTTTGGTGGATAAAATGAG
TAGATGGAAGACTTATGCTCAGGATCACAGAGACGAGCCTGGGATCATGGGGATTACAAGTAGAGCGAG
CCGTAGACGCCAGCGCCATGACAGACAGAGGGGTCTTGTGTGGGACGATGAGGATTCGGCCGATGATAG
CAGCGTGCTGGACTTGGGTGGGAGAGGAAGGGGCAACCCGTTTGCTCATTTGCGCCCTCGCTTGGGTGG
TATGTTGTAAAAAAAATAAAAAAAAAACTCACCAAGGCCATGGCGACGAGCGTACGTTCGTTCTTCTT
TATTATCTGTGTCTAGTATAATGAGGCGAGTCGTGCTAGGCGGAGCGGTGGTGTATCCGGAGGGTCCTC
CTCCTTCGTACGAGAGCGTGATGCAGCAGCAGCAGGCGACGGCGGTGATGCAATCCCCACTGGAGGCTC
CCTTTGTGCCTCCGCGATACCTGGCACCTACGGAGGGCAGAAACAGCATTCGTTATTCGGAACTGGCAC
CTCAGTACGATACCACCAGGTTGTATCTGGTGGACAACAAGTCGGCGGACATTGCTTCTCTGAACTATC
AGAATGACCACAGCAACTTCTTGACCACGGTGGTGCAAAACAATGACTTTACCCCTACGGAAGCCAGCA
CCCAGACCATTAACTTTGATGAACGATCGCGGTGGGCGGTCAGCTAAAGACCATCATGCATACTAACA
TGCCAAACGTGAACGAGTATATGTTTAGTAACAAGTTCAAAGCGCGTGTGATGGTGTCCAGAAAACCTC
CCGACGGTGCTGCAGTTGGGGATACTTATGATCACAAGCAGGATATTTTGAAATATGAGTGGTTCGAGT
TTACTTTGCCAGAAGGCAACTTTTCAGTTACTATGACTATTGATTTGATGAACAATGCCATCATAGATA
ATTACTTGAAAGTGGGTAGACAGAATGGAGTGCTTGAAAGTGACATTGGTGTTAAGTTCGACACCAGGA
ACTTCAAGCTGGGATGGATCCCGAAACCAAGTTGATCATGCCTGGAGTGTATACGTATGAAGCCTTCC
ATCCTGACATTGTCTTACTGCCTGGCTGCGGAGTGGATTTTACCGAGAGTCGTTTGAGCAACCTTCTTG
GTATCAGAAAAAAACAGCCATTTCAAGAGGGTTTTAAGATTTTGTATGAAGATTTAGAAGGTGGTAATA
TTCCGGCCCTCTTGGATGTAGATGCCTATGAGAACAGTAAGAAAGAACAAAAAGCCAAAATAGAAGCTG
CTACAGCTGCTGCAGAAGCTAAGGCAAACATAGTTGCCAGCGACTCTACAAGGGTTGCTAACGCTGGAG
AGGTCAGAGGAGACAATTTTGCGCCAACACCTGTTCCGACTGCAGAATCATTATTGGCCGATGTGTCTG
AAGGAACGGACGTGAAACTCACTATTCAACCTGTAGAAAAGATAGTAAGAATAGAAGCTATAATGTGT
TGGAAGACAAAATCAACACAGCCTATCGCAGTTGGTATCTTTCGTACAATTATGGCGATCCCGAAAAAG
GAGTGCGTTCCTGGACATTGCTCACCACCTCAGATGTCACCTGCGGAGCAGAGCAGGTCTACTGGTCGC
TTCCAGACATGATGAAGGATCCTGTCACTTTCCGCTCCACTAGACAAGTCAGTAACTACCCTGTGGTGG
GTGCAGAGCTTATGCCCGTCTTCTCAAAGAGCTTCTACAACGAACAAGCTGTGTACTCCCAGCAGCTCC
GCCAGTCCACCTCGCTTACGCACGTCTTCAACCGCTTTCCTGAGAACCAGATTTTAATCCGTCCGCCGG
CGCCCACCATTACCACCGTCAGTGAAAACGTTCCTGCTCTCACAGATCACGGGACCCTGCCGTTGCGCA
GCAGTATCCGGGGAGTCCAACGTGTGACCGTTACTGACGCCAGACGCCGCACCTGTCCCTACGTGTACA
AGGCACTGGGCATAGTCGCACCGCGCGTCCTTTCAAGCCGCACTTTCTAAAAAAAAAAAAAAATGTCCAT
```

Figure 67 continued

```
TCTTATCTCGCCCAGTAATAACACCGGTTGGGGTCTGCGCGCTCCAAGCAAGATGTACGGAGGCGCACG
CAAACGTTCTACCCAACATCCTGTCCGTGTTCGCGGACATTTTCGCGCTCCATGGGGCGCCCTCAAGGG
CCGCACTCGCGTTCGAACCACCGTCGATGATGTAATCGATCAGGTGGTTGCCGACGCCCGTAATTATAC
TCCTACTGCGCCTACATCTACTGTGGATGCAGTTATTGACAGTGTAGTGGCTGACGCTCGCAACTATGC
TCGACGTAAGAGCCGGCGAAGGCGCATTGCCAGACGCCACCGAGCTACCACTGCCATGCGAGCCGCAAG
AGCTCTGCTACGAAGAGCTAGACGCGTGGGCGAAGAGCCATGCTTAGGGCGGCCAGACGTGCAGCTTC
GGGCGCCAGCGCCGGCAGGTCCCGCAGGCAAGCAGCCGCTGTCGCAGCGGCGACTATTGCCGACATGGC
CCAATCGCGAAGAGGCAATGTATACTGGGTGCGTGACGCTGCCACCGGTCAACGTGTACCCGTGCGCAC
CCGTCCCCCTCGCACTTAGAAGATACTGAGCAGTCTCCGATGTTGTGTCCCAGCGGCGAGGATGTCCAA
GCGCAAATACAAGGAAGAAATGCTGCAGGTTATCGCACCTGAAGTCTACGGCCAACCGTTGAAGGATGA
AAAAAAACCCCGCAAAATCAAGCGGGTTAAAAAGGACAAAAAAGAAGAGGAAGATGGCGATGATGGGCT
GGCGGAGTTTGTGCGCGAGTTTGCCCCACGGCGACGCGTGCAATGGCGTGGGCGCAAAGTTCGACATGT
GTTGAGACCTGGAACTTCGGTGGTCTTTACACCCGGCGAGCGTTCAAGCGCTACTTTTAAGCGTTCCTA
TGATGAGGTGTACGGGGATGATGATATTCTTGAGCAGGCGGCTGACCGATTAGGCGAGTTTGCTTATGG
CAAGCGTAGTAGAATAACTTCCAAGGATGAGACAGTGTCGATACCCTTGGATCATGGAAATCCCACCCC
TAGTCTTAAACCGGTCACTTTGCAGCAAGTGTTACCCGTAACTCCGCGAACAGGTGTTAAACGCGAAGG
TGAAGATTTGTATCCCACTATGCAACTGATGGTACCCAAACGCCAGAAGTTGGAGGACGTTTTGGAGAA
AGTAAAAGTGGATCCAGATATTCAACCTGAGGTTAAAGTGAGACCCATTAAGCAGGTAGCGCCTGGTCT
GGGGGTACAAACTGTAGACATTAAGATTCCCACTGAAAGTATGGAAGTGCAAACTGAACCCGCAAAGCC
TACTGCCACCTCCACTGAAGTGCAAACGGATCCATGGATGCCCATGCCTATTACAACTGACGCCGCCGG
TCCCACTCGAAGATCCCGACGAAAGTACGGTCCAGCAAGTCTGTTGATGCCCAATTATGTTGTACACCC
ATCTATTATTCCTACTCCTGGTTACCGAGGCACTCGCTACTATCGCAGCCGAAACAGTACCTCCCGCCG
TCGCCGCAAGACACCTGCAAATCGCAGTCGTCGCCGTAGACGCACAAGCAAACCGACTCCCGGCGCCCT
GGTGCGGCAAGTGTACCGCAATGGTAGTGCGGAACCTTTGACACTGCCGCGTGCGCGTTACCATCCGAG
TATCATCACTTAATCAATGTTGCCGCTGCCTCCTTGCAGATATGGCCCTCACTTGTCGCCTTCGCGTTC
CCATCACTGGTTACCGAGGAAGAAACTCGCGCCGTAGAAGAGGGATGTTGGGACGCGGAATGCGACGCT
ACAGGCGACGGCGTGCTATCCGCAAGCAATTGCGGGGTGGTTTTTTACCAGCCTTAATTCCAATTATCG
CTGCTGCAATTGGCGCGATACCAGGCATAGCTTCCGTGGCGGTTCAGGCCTCGCAACGACATTGACATT
GGAAAAAAACGTATAAATAAAAAAAAAAAATACAATGGACTCTGACACTCCTGGTCCTGTGACTATGT
TTTCTTAGAGATGGAAGACATCAATTTTTCATCCTTGGCTCCGCGACACGGCACGAAGCCGTACATGGG
CACCTGGAGCGACATCGGCACGAGCCAACTGAACGGGGGCGCCTTCAATTGGAGCAGTATCTGGAGCGG
GCTTAAAAATTTTGGCTCAACCATAAAAACATACGGGAACAAAGCTTGGAACAGCAGTACAGGACAGGC
GCTTAGAAATAAACTTAAAGACCAGAACTTCCAACAAAAGTAGTCGATGGGATAGCTTCCGGCATCAA
TGGAGTGGTAGATTTGGCTAACCAGGCTGTGCAGAAAAAGATAAACAGTCGTTTGGACCCGCCGCCAGC
AACCCCAGGTGAAATGCAAGTGGAGGAAGAAATTCCTCCGCCAGAAAAACGAGGCGACAAGCGTCCGCG
TCCCGATTTGGAAGAGACGCTGGTGACGCGCGTAGATGAACCGCCTTCTTATGAGGAAGCAACGAAGCT
TGGAATGCCCACCACTAGACCGATAGCCCCAATGGCCACCGGGGTGATGAAACCTTCTCAGTTGCATCG
ACCCGTCACCTTGGATTTGCCCCCTCCCCCTGCTGCTACTGCTGTACCCGCTTCTAAGCCTGTCGCTGC
CCCGAAACCAGTCGCCGTAGCCAGGTCACGTCCCGGGGCGCTCCTCGTCCAAATGCGCACTGGCAAAA
TACTCTGAACAGCATCGTGGGTCTAGGCGTGCAAAGTGTAAAACGCCGTCGCTGCTTTTAATTAAATAT
GGAGTAGCGCTTAACTTGCCTATCTGTGTATATGTGTCATTACACGCCGTCACAGCAGCAGAGGAAAAA
AGGAAGAGGTCGTGCGTCGACGCTGAGTTACTTTCAAGATGGCCACCCCATCGATGCTGCCCCAATGGG
CATACATGCACATCGCCGGACAGGATGCTTCGGAGTACCTGAGTCCGGGTCTGGTGCAGTTCGCCCGCG
CCACAGACACCTACTTCAATCTGGGAAATAAGTTTAGAAATCCCACCGTAGCGCCGACCCACGATGTGA
CCACCGACCGTAGCCAGCGGCTCATGTTGCGCTTCGTGCCCGTTGACCGGGAGGACAATACATACTCTT
ACAAAGTGCGGTACACCCTGGCCGTGGGCGACAACAGAGTGCTGGATATGGCCAGCACGTTCTTTGACA
TTAGGGGTGTGTTGGACAGAGGTCCCAGTTTCAAACCCTATTCTGGTACGGCTTACAACTCCCTGGCTC
CTAAAGGCGCTCCAAATACATCTCAGTGGATTGCAGAAGGTGTAAAAAATACAACTGGTGAGGAACACG
TAACAGAAGAGGAAACCAATACTACTACTTACACTTTTGGCAATGCTCCTGTAAAAGCTGAAGCTGAAA
```

Figure 67 continued

```
TTACAAAAGAAGGACTCCCAGTAGGTTTGGAAGTTTCAGATGAAGAAAGTAAACCGATTTATGCTGATA
AAACATATCAGCCAGAACCTCAGCTGGGAGATGAAACTTGGACTGACCTTGATGGAAAAACCGAAAAGT
ATGGAGGCAGGGCTCTCAAACCCGATACTAAGATGAAACCATGCTACGGGTCCTTTGCCAAACCTACTA
ATGTGAAAGGCGGTCAGGCAAAACAAAAACAACGGAGCAGCCAAATCAGAAAGTCGAATATGATATCG
ACATGGAGTTTTTTGATGCGGCATCGCAGAAAACAAACTTAAGTCCTAAAATTGTCATGTATGCAGAAA
ATGTAAATTTGGAAACTCCAGACACTCATGTAGTGTACAAACCTGGAACAGAAGACACAAGTTCCGAAG
CTAATTTGGGACAACAATCTATGCCCAACAGACCCAACTACATTGGCTTCAGAGATAACTTTATTGGAC
TTATGTACTATAACAGTACTGGTAACATGGGGGTGCTGGCTGGTCAAGCGTCTCAGTTAAATGCAGTGG
TTGACTTGCAGGACAGAAACACAGAACTTTCTTACCAACTCTTGCTTGACTCTCTGGGCGACAGAACCA
GATACTTTAGCATGTGGAATCAGGCTGTGGACAGTTATGATCCTGATGTACGTGTTATTGAAATCATG
GTGTGGAAGATGAACTTCCCAACTACTGTTTTCCACTGGACGGCATAGGTGTTCCAACAACCAGTTACA
AATCAATAGTTCCAAATGGAGACAATGCGCCTAATTGGAAGGAACCTGAAGTAAATGGAACAAGTGAGA
TCGGACAGGGTAATTTGTTTGCCATGGAAATTAACCTTCAAGCCAATCTATGGCGAAGTTTCCTTTATT
CCAATGTGGCTCTATATCTCCCAGACTCGTACAAATACACCCGTCCAATGTCACTCTTCCAGAAAACA
AAAACACCTACGACTACATGAACGGGCGGGTGGTGCCGCCATCTCTAGTAGACACCTATGTGAACATTG
GTGCCAGGTGGTCTCTGGATGCCATGGACAATGTCAACCCATTCAACCACCACCGTAACGCTGGCTTGC
GTTACCGATCCATGCTTCTGGGTAACGGACGTTATGTGCCTTTCCACATACAAGTGCCTCAAAAATTCT
TCGCTGTTAAAAACCTGCTGCTTCTCCCAGGCTCCTACACTTATGAGTGGAACTTTAGGAAGGATGTGA
ACATGGTTCTACAGAGTTCCCTCGGTAACGACCTGCGGGTAGATGGCGCCAGCATCAGTTTCACGAGCA
TCAACCTCTATGCTACTTTTTTCCCCATGGCTCACAACACCGCTTCCACCCTTGAAGCCATGCTGCGGA
ATGACACCAATGATCAGTCATTCAACGACTACCTATCTGCAGCTAACATGCTCTACCCCATTCCTGCCA
ATGCAACCAATATTCCCATTTCCATTCCTTCTCGCAACTGGGCGGCTTTCAGAGGCTGGTCATTTACCA
GACTGAAAACCAAAGAAACTCCCTCTTTGGGGTCTGGATTTGACCCCTACTTTGTCTATTCTGGTTCTA
TTCCCTACCTGGATGGTACCTTCTACCTGAACCACACTTTTAAGAAGGTTTCCATCATGTTTGACTCTT
CAGTGAGCTGGCCTGGAAATGACAGGTTACTATCTCCTAACGAATTTGAAATAAAGCGCACTGTGGATG
GCGAAGGCTACAACGTAGCCCAATGCAACATGACCAAAGACTGGTTCTTGGTACAGATGCTCGCCAACT
ACAACATCGGCTATCAGGGCTTCTACATTCCAGAAGGATACAAAGATCGCATGTATTCATTTTTCAGAA
ACTTCCAGCCCATGAGCAGGCAGGTGGTTGATGAGGTCAATTACAAAGACTTCAAGGCCGTCGCCATAC
CCTACCAACACAACAACTCTGGCTTTGTGGGTTACATGGCTCCGACCATGCGCCAAGGTCAACCCTATC
CCGCTAACTATCCCTATCCACTCATTGGAACAACTGCCGTAAATAGTGTTACGCAGAAAAAGTTCTTGT
GTGACAGAACCATGTGGCGCATACCGTTCTCGAGCAACTTCATGTCTATGGGGGCCCTTACAGACTTGG
GACAGAATATGCTCTATGCCAACTCAGCTCATGCTCTGGACATGACCTTTGAGGTGGATCCCATGGATG
AGCCCACCCTGCTTTATCTTCTTCAAGTTTTCGACGTGGTCAGAGTGCATCAGCCACACCGCGGCA
TCATCGAGGCAGTCTACCTGCGTACACCGTTCTCGGCCGGTAACGCTACCACGTAAGAAGCTTCTTGCT
TCTTGCAAATAGCAGCTGCAACCATGGCCTGCGGATCCCAAAACGGCTCCAGCGAGCAAGAGCTCAGAG
CCATTGTCCAAGACCTGGGTTGCGGACCCTATTTTTGGGAACCTACGATAAGCGCTTCCCGGGGTTCA
TGGCCCCGATAAGCTCGCCTGTGCCATTGTAAATACGGCCGGACGTGAGACGGGGGGAGAGCACTGGT
TGGCTTTCGGTTGGAACCCACGTTCTAACACCTGCTACCTTTTGATCCTTTTGGATTCTCGGATGATC
GTCTCAAACAGATTTACCAGTTTGAATATGAGGGTCTCCTGCGCCGCAGCGCTCTTGCTACCAAGGACC
GCTGTATTACGCTGGAAAAATCTACCCAGACCGTGCAGGGTCCCGTTCTGCCGCCTGCGGACTTTCT
GCTGCATGTTCCTTCACGCCTTTGTGCACTGGCCTGACCGTCCCATGGACGGAAACCCCACCATGAAAT
TGCTAACTGGAGTGCCAAACAACATGCTTCATTCTCCTAAAGTCCAGCCCACCCTGTGTGACAATCAAA
AAGCACTCTACCATTTTCTTAATACCCATTCGCCTTATTTTCGCTCCCATCGTACACACATCGAAAGGG
CCACTGCGTTCGACCGTATGGATGTTCAATAATGACTCATGTAAACAACGTGTTCAATAAACATCACTT
TATTTTTTTACATGTATCAAGGCTCTGCATTACTTATTTATTTACAAGTCGAATGGGTTCTGACGAGAA
TCAGAATGACCCGCAGGCAGTGATACGTTGCGGAACTGATACTTGGGTTGCCACTTGAATTCGGGAATC
ACCAACTTGGGAACCGGTATATCGGGCAGGATGTCACTCCACAGCTTTCTGGTCAGCTGCAAAGCTCCA
AGCAGGTCAGGAGCCGAAATCTTGAAATCACAATTAGGACCAGTGCTTTGAGCGCGAGAGTTGCGGTAC
ACCGGATTGCAGCACTGAAACACCATCAGCGACGGATGTCTCACGCTTGCCAGCACGGTGGGATCTGCA
```

Figure 67 continued

```
ATCATGCCCACATCCAGATCTTCAGCATTGGCAATGCTGAACGGGGTCATCTTGCAGGTCTGCCTACCC
ATGGCGGGCACCCAATTAGGCTTGTGGTTGCAATCGCAGTGCAGGGGGATCAGTATCATCTTGGCCTGA
TCCTGTCTGATTCCTGGATACACGGCTCTCATGAAAGCATCATATTGCTTGAAAGCCTGCTGGGCTTTA
CTACCCTCGGTATAAAACATCCCGCAGGACCTGCTCGAAAACTGGTTAGCTGCACAGCCGGCATCATTC
ACACAGCAGCGGGCGTCATTGTTAGCTATTTGCACCACACTTCTGCCCCAGCGGTTTTGGGTGATTTTG
GTTCGCTCGGGATTCTCCTTTAAGGCTCGTTGTCCGTTCTCGCTGGCCACATCCATCTCGATAATCTGC
TCCTTCTGAATCATAATATTGCCATGCAGGCACTTCAGCTTGCCCTCATAATCATTGCAGCCATGAGGC
CACAACGCACAGCCTGTACATTCCCAATTATGGTGGGCGATCTGAGAAAAGAATGTATCATTCCCTGC
AGAAATCTTCCCATCATCGTGCTCAGTGTCTTGTGACTAGTGAAAGTTAACTGGATGCCTCGGTGCTCC
TCGTTTACGTACTGGTGACAGATGCGCTTGTATTGTTCGTGTTGCTCAGGCATTAGTTTAAAAGAGGTT
CTAAGTTCGTTATCCAGCCTGTACTTCTCCATCAGCAGACACATCACTTCCATGCCTTTCTCCCAAGCA
GACACCAGGGGCAAGCTAATCGGATTCTTAACAGTGCAGGCAGCAGCTCCTTTAGCCAGAGGGTCATCT
TTAGCGATCTTCTCAATGCTTCTTTTGCCATCCTTCTCAACGATGCGCACGGGCGGGTAGCTGAAACCC
ACTGCTACAAGTTGCGCCTCTTCTCTTTCTTCTTCGCTGTCTTGACTGATGTCTTGCATGGGGATATGT
TTGGTCTTCCTTGGCTTCTTTTTGGGGGGTATCGGAGGAGGAGGACTGTCGCTCCGTTCCGGAGACAGG
GAGGATTGTGACGTTTCGCTCACCATTACCAACTGACTGTCGGTAGAAGAACCTGACCCCACACGGCGA
CAGGTGTTTCTCTTCGGGGCAGAGGTGGAGGCGATTGCGAAGGGCTGCGGTCCGACCTGGAAGGCGGA
TGACTGGCAGAACCCCTTCCGCGTTCGGGGGTGTGCTCCCTGTGGCGGTCGCTTAACTGATTTCCTTCG
CGGCTGGCCATTGTGTTCTCCTAGGCAGAGAAACAACAGACATGGAAACTCAGCCATTGCTGTCAACAT
CGCCACGAGTGCCATCACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATGACATGCAGAATAAAA
AAGCGAAAGAGTCTGAGACAGACATCGAGCAAGACCCGGGCTATGTGACACCGGTGGAACACGAGGAAG
AGTTGAAACGCTTTCTAGAGAGAGAGGATGAAAACTGCCCAAAACAACGAGCAGATAACTATCACCAAG
ATGCTGGAAATAGGGATCAGAACACCGACTACCTCATAGGGCTTGACGGGGAAGACGCGCTCCTTAAAC
ATCTAGCAAGACAGTCGCTCATAGTCAAGGATGCATTATTGGACAGAACTGAAGTGCCCATCAGTGTGG
AAGAGCTCAGCCGCGCCTACGAGCTTAACCTCTTTTCACCTCGTACTCCCCCCAAACGTCAGCCAAACG
GCACCTGCGAGCCAAATCCTCGCTTAAACTTTTATCCAGCTTTTGCTGTGCCAGAAGTACTGGCTACCT
ATCACATCTTTTTTAAAAATCAAAAAATTCCAGTCTCCTGCCGCGCTAATCGCACCCGCGCCGATGCCC
TACTCAATCTGGGACCTGGTTCACGCTTACCTGATATAGCTTCCTTGGAAGAGGTTCCAAAGATCTTCG
AGGGTCTGGGCAATAATGAGACTCGGGCCGCAAATGCTCTGCAAAAGGGAGAAAATGGCATGGATGAGC
ATCACAGCGTTCTGGTGGAATTGGAAGGCGATAATGCCAGACTCGCAGTACTCAAGCGAAGCATCGAGG
TCACACACTTCGCATATCCCGCTGTCAACCTGCCCCCTAAAGTCATGACGGCGGTCATGGACCAGTTAC
TCATTAAGCGCGCAAGTCCCCTTTCAGAAGACATGCATGACCCAGATGCCTGTGATGAGGGTAAACCAG
TGGTCAGTGATGAGCAGCTAACCCGATGGCTGGGCACCGACTCTCCCAGGGATTTGGAAGAGCGTCGCA
AGCTTATGATGGCCGTGGTGCTGGTTACCGTAGAACTAGAGTGTCTCCGACGTTTCTTTACCGATTCAG
AAACCTTGCGCAAACTCGAAGAGAATCTGCACTACACTTTTAGACACGGCTTTGTGCGGCAGGCATGCA
AGATATCTAACGTGGAACTCACCAACCTGGTTTCCTACATGGGTATTCTGCATGAGAATCGCCTAGGAC
AAAGCGTGCTGCACAGCACCCTGAAGGGGAAGCCCGCCGTGATTACATCCGCGATTGTGTCTATCTGT
ACCTGTGCCACACGTGGCAAACCGGCATGGGTGTATGGCAGCAATGTTTAGAAGAACAGAACTTGAAAG
AGCTTGACAAGCTCTTACAGAAATCTCTTAAGGTTCTGTGGACAGGGTTCGACGAGCGCACCGTCGCTT
CCGACCTGGCAGACCTCATCTTCCCAGAGCGTCTCAGGGTTACTTTGCGAAACGGATTGCCTGACTTTA
TGAGCCAGAGCATGCTTAACAATTTTCGCTCTTTCATCCTGGAACGCTCCGGTATCCTGCCCGCCACCT
GCTGCGCACTGCCCTCCGACTTTGTGCCTCTCACCTACCGCGAGTGCCCCCGCCGCTATGGAGTCACT
GCTACCTGTTCCGTCTGGCCAACTATCTCTCCTACCACTCGGATGTGATCGAGGATGTGAGCGGAGACG
GCTTGCTGGAGTGTCACTGCCGCTGCAATCTGTGCACGCCCCACCGGTCCCTAGCTTGCAACCCCAGT
TGATGAGCGAAACCCAGATAATAGGCACCTTTGAATTGCAAGGCCCCAGCAGCCAAGGCGATGGGTCTT
CTCCTGGGCAAAGTTTAAAACTGACCCCGGGACTGTGGACCTCCGCCTACTTGCGCAAGTTTGCTCCGG
AAGATTACCACCCCTATGAAATCAAGTTCTATGAGGACCAATCACAGCCTCCAAAGGCCGAACTTTCGG
CCTGCGTCATCACCCAGGGGGCAATTCTGGCCCAATTGCAAGCCATCCAAAAATCCCGCCAAGAATTTC
```

Figure 67 continued

```
TACTGAAAAAGGGTAAGGGGGTCTACCTTGACCCCCAGACCGGCGAGGAACTCAACACAAGGTTCCCTC
AGGATGTCCCAACGACGAGAAAACAAGAAGTTGAAGGTGCAGCCGCCGCCCCCAGAAGATATGGAGGAA
GATTGGGACAGTCAGGCAGAGGAGGCGGAGGAGGACAGTCTGGAGGACAGTCTGGAGGAAGACAGTTTG
GAGGAGGAAAACGAGGAGGCAGAGGAGGTGGAAGAAGTAACCGCCGACAAACAGTTATCCTCGGCTGCG
GAGACAAGCAACAGCGCTACCATCTCCGCTCCGAGTCGAGGAACCCGGCGGCGTCCCAGCAGTAGATGG
GACGAGACCGGACGCTTCCCGAACCCAACCAGCGCTTCCAAGACCGGTAAGAAGGATCGGCAGGGATAC
AAGTCCTGGCGGGGGCATAAGAATGCCATCATCTCCTGCTTGCATGAGTGCGGGGGCAACATATCCTTC
ACGCGGCGCTACTTGCTATTCCACCATGGGGTGAACTTTCCGCGCAATGTTTTGCATTACTACCGTCAC
CTCCACAGCCCCTACTATAGCCAGCAAATCCCGGCAGTCTCGACAGATAAAGACAGCGGCGGCGACCTC
CAACAGAAACCAGCAGCGGCAGTTAGAAAATACACAACAAGTGCAGCAACAGGAGGATTAAAGATTAC
AGCCAACGAGCCAGCGCAAACCCGAGAGTTAAGAAATCGGATCTTTCCAACCCTGTATGCCATCTTCCA
GCAGAGTCGGGGTCAAGAGCAGGAACTGAAAATAAAAAACCGATCTCTGCGTTCGCTCACCAGAAGTTG
TTTGTATCACAAGAGCGAAGATCAACTTCAGCGCACTCTCGAGGACGCCGAGGCTCTCTTCAACAAGTA
CTGCGCGCTGACTCTTAAAGAGTAGGCAGCGACCGCGCTTATTCAAAAAGGCGGGAATTACATCATCC
TCGACATGAGTAAAGAAATTCCCACGCCTTACATGTGGAGTTATCAACCCCAAATGGGATTGGCGGCAG
GCGCCTCCCAGGACTACTCCACCCGCATGAATTGGCTCAGCGCCGGGCCTTCTATGATTTCTCGAGTTA
ATGATATACGCGCCTACCGAAACCAAATACTTTTGGAACAGTCAGCTCTTACCACCACGCCCCGCCAAC
ACCTTAATCCCAGAAATTGGCCCGCCGCCCTAGTGTACCAGGAAAGTCCCGCTCCCACCACTGTATTAC
TTCCTCGAGACGCCCAGGCCGAAGTCCAAATGACTAATGCAGGTGCGCAGTTAGCTGGCGGCTCCACCC
TATGTCGTCACAGGCCTCGGCATAATATAAAACGCCTGATGATCAGAGGCCGAGGTATCCAGCTCAACG
ACGAGTCGGTGAGCTCTCCGCTTGGTCTACGACCAGACGGAATCTTTCAGATTGCCGGCTGCGGGAGAT
CTTCCTTCACCCCTCGTCAGGCTGTTCTGACTTTGGAAAGTTCGTCTTCGCAACCCCGCTCGGGCGGAA
TCGGGACCGTTCAATTTGTGGAGGAGTTTACTCCCTCTGTCTACTTCAACCCCTTCTCCGGATCTCCTG
GGCATTACCCGGACGAGTTCATACCGAACTTCGACGCGATTAGCGAGTCAGTGGACGGCTACGATTGAT
GTCTGGTGACGCGGCTGAGCTATCTCGGCTGCGACATCTAGACCACTGCCGCCGCTTTCGCTGCTTTGC
CCGGGAACTCATTGAGTTCATCTACTTCGAACTCCCCAAGGATCACCCTCAAGGTCCGGCCCACGGAGT
GCGGATTTCTATCGAAGGCAAAATAGACTCTCGCCTGCAACGAATTTTCTCCCAGCGGCCCGTGCTGAT
CGAGCGAGACCAGGGAAACACCACGGTTTCCATCTACTGCATTTGTAATCACCCCGGATTGCATGAAAG
CCTTTGCTGTCTTATGTGTACTGAGTTTAATAAAAACTGAATTAAGACTCTCCTACGGACTGCCGCTTC
TTCAACCCGGATTTTACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTTCCCTACTAATACTA
CTTTCAAAACCGGAGGTGAGCTCCAAGGTCTTCCTACAGAAAACCCTTGGGTGGAAGCGGGCCTTGTAG
TGCTAGGAATTCTTGCGGGTGGCTTGTGATTATTCTTTGCTACCTATACACACCTTGCTTCACTTTCT
TAGTGGTGTTGTGGTATTGGTTTAAAAAATGGGGCCCATACTAGTCTTGCTTGTTTTACTTTCGCTTTT
GGAACCGGGTTCTGCCAATTACGATCCATGTCTAGACTTCGACCCAGAAAACTGCACACTTACTTTTGC
ACCCGACACAAGCCGCATCTGTGGAGTTCATCGCCTCTCTTACGAACTTGGCCCCAACGACAAAAATT
TACCTGCATGGTGGGAATCAACCCCATAGTTATCACCCAGCAAAGTGGAGATACTAAGGGTTGCATTCA
CTGCTCCTGCGATTCCATCGAGTGCACCTACACCCTGCTGAAGACCCTATGCGGCCTAAGAGACCTGCT
ACCAATGAATTAAAAAATGATTAATAAAAAATCACTTACTTGAAATCAGCAATAAGGTCTCTGTTGAAA
TTTTCTCCCAGCAGCACCTCACTTCCCTCTTCCCAACTCTGGTATTCTAAACCCCGTTCAGCGGCATAC
TTTCTCCATACTTTAAAGGGGATGTCAAATTTTAGCTCCTCTCCTGTACCCACAATCTTCATGTCTTTC
TTCCCAGATGACCAAGAGAGTCCGGCTCAGTGACTCCTTCAACCCTGTCTACCCCTATGAAGATGAAAG
CACCTCCCAACACCCCTTTATAAACCCAGGGTTTATTTCCCCAAATGGCTTCACACAAAGCCCAAACGG
AGTTCTTACTTTAAAATGTTTAACCCCACTAACAACCACAGGCGGATCTCTACAGCTAAAAGTGGGAGG
GGGACTTACAGTGGATGACACCAACGGTTTTTTGAAAGAAAACATAAGTGCCACCACACCACTCGTTAA
GACTGGTCACTCTATAGGTTTACCACTAGGAGCCGGATTGGGAACGAATGAAAATAAACTTTGTATCAA
ATTAGGACAAGGACTTACATTCAATTCAAACAACATTTGCATTGATGACAATATTAACACCTTATGGAC
AGGAGTCAACCCCACCGAAGCCAACTGTCAAATCATGAACTCCAGTGAATCTAATGATTGCAAATTAAT
TCTAACACTAGTTAAAACTGGAGCACTAGTCACTGCATTTGTTTATGTTATAGGAGTATCTAACAATTT
```

Figure 67 continued

```
TAATATGCTAACTACACACAGAAATATAAATTTTACTGCAGAGCTGTTTTTCGATTCTACTGGTAATTT
ACTAACTAGACTCTCATCCCTCAAAACTCCACTTAATCATAAATCAGGACAAAACATGGCTACTGGTGC
CATTACTAATGCTAAAGGTTTCATGCCCAGCACGACTGCCTATCCTTTCAATGATAATTCTAGAGAAAA
AGAAAACTACATTTACGGAACTTGTTACTACACAGCTAGTGATCGCACTGCTTTTCCCATTGACATATC
TGTCATGCTTAACCGAAGAGCAATAAATGACGAGACATCATATTGTATTCGTATAACTTGGTCCTGGAA
CACAGGAGATGCCCCAGAGGTGCAAACCTCTGCTACAACCCTAGTCACCTCCCCATTTACCTTTTACTA
CATCAGAGAAGACGACTGACAAATAAAGTTTGCGATCGCCAGGCCCACCATGGGATGGAGCTGTATCAT
CCTCTTCTTGGTAGCAACAGCTACAGGTGTCCACTCCCAGGTGCAGCTGCAGCAGTCTGGGGCTGAACT
GGCAAGACCTGGGGCCTCAGTGAAGATGTCCTGCAAGGCTTCTGGCTACACCTTTACTAGGTACACGAT
GCACTGGGTAAAACAGAGGCCTGGACAGGGTCTGGAATGGATTGGATACATTAATCCTAGCCGTGGTTA
TACTAATTACAATCAGAAGTTCAAGGACAAGGCCACATTGACTACAGACAAATCCTCCAGCACAGCCTA
CATGCAACTGAGCAGCCTGACATCTGAGGACTCTGCAGTCTATTACTGTGCAAGATATTATGATGATCA
TTACTGCCTTGACTACTGGGGCCAAGGCACCACTCTCACAGTCTCCTCAGGTGGCGGTGGCTCGGGCGG
TGGTGGATCTGGTGGCGGCGGATCTGATATCGTGCTCACTCAGTCTCCAGCAATCATGTCTGCATCTCC
AGGGGAGAAGGTCACCATGACCTGCAGTGCCAGCTCAAGTGTAAGTTACATGAACTGGTACCAGCAGAA
GTCAGGCACCTCCCCCAAAAGATGGATTTATGACACATCCAAACTGGCTTCTGGAGTCCCTGCTCACTT
CAGGGGCAGTGGGTCTGGGACCTCTTACTCTCTCACAATCAGCGGCATGGAGGCTGAAGATGCTGCCAC
TTATTACTGCCAGCAGTGGAGTAGTAACCCATTCACGTTCGGCTCGGGGACAAAGTTGGAAATAAACCG
GGGATCCGAACAAAAACTCATCTCAGAAGAGGATCTGAATGCTGTGGGCCAGGACACGCAGGAGGTCAT
CGTGGTGCCACACTCCTTGCCCTTTAAGGTGGTGGTGATCTCAGCCATCCTGGCCCTGGTGGTGCTCAC
CATCATCTCCCTTATCATCCTCATCATGCTTTGGCAGAAGAAGCCACGTGGTTCAATCCCTAACCCTCT
CCTCGGTCTCGATTAAGCTAGCTTGACTGACTGAGATACAGCGTACCTTCAGCTCACAGACATGATAAG
ATACATTGATGAGTTTGGACAAACCACAACTAGAATGCAGTGAAAAAAATGCTTTATTTGTGAAATTTG
TGATGCTATTGCTTTATTTGTAACCATTATAAGCTGCAATAAACAAGTTAACAACAACAATTGCATTCA
TTTTATGTTTCAGGTTCAGGGGGAGGTGTGGGAGGTTTTTTAAAGCAAGTAAAACCTCTACAAATGTGG
TAGTCGTCAGCTATCCTGCAGGAACTTGTTTATTTGAAAATCAATTCACAAAATCCGAGTAGTTATTTT
GCCTCCCCCTTCCCATTTAACAGAATACACCAATCTCTCCCCACGCACAGCTTTAAACATTTGGATACC
ATTAGATATAGACATGGTTTTAGATTCCACATTCCAAACAGTTTCAGAGCGAGCCAATCTGGGGTCAGT
GATAGATAAAAATCCATCGGGATAGTCTTTTAAAGCGCTTTCACAGTCCAACTGCTGCGGATGCGACTC
CGGAGTCTGGATCACGGTCATCTGGAAGAAGAACGATGGGAATCATAATCCGAAAACGGTATCGGACGA
TTGTGTCTCATCAAACCCACAAGCAGCCGCTGTCTGCGTCGCTCCGTGCGACTGCTGTTTATGGGATCA
GGGTCCACAGTGTCCTGAAGCATGATTTAATAGCCCTTAACATCAACTTTCTGGTGCGATGCGCGCAG
CAACGCATTCTGATTTCACTCAAATCTTTGCAGTAGGTACAACACATTATTACAATATTGTTTAATAAA
CCATAATTAAAAGCGCTCCAGCCAAAACTCATATCTGATATAATCGCCCCTGCATGACCATCATACCAA
AGTTTAATATAAATTAAATGACGTTCCCTCAAAAACACACTACCCACATACATGATCTCTTTTGGCATG
TGCATATTAACAATCTGTCTGTACCATGGACAACGTTGGTTAATCATGCAACCCAATATAACCTTCCGG
AACCACACTGCCAACACCGCTCCCCAGCCATGCATTGAAGTGAACCCTGCTGATTACAATGACAATGA
AGAACCCAATTCTCTCGACCGTGAATCACTTGAGAATGAAAAATATCTATAGTGGCACAACATAGACAT
AAATGCATGCATCTTCTCATAATTTTTAACTCCTCAGGATTTAGAAACATATCCCAGGGAATAGGAAGC
TCTTGCAGAACAGTAAAGCTGGCAGAACAAGGAAGACCACGAACACAACTTACACTATGCATAGTCATA
GTATCACAATCTGGCAACAGCGGGTGGTCTTCAGTCATAGAAGCTCGGGTTTCATTTTCCTCACAACGT
GGTAACTGGGCTCTGGTGTAAGGGTGATGTCTGGCGCATGATGTCGAGCGTGCGCGCAACCTTGTCATA
ATGGAGTTGCTTCCTGACATTCTCGTATTTTGTATAGCAAAACGCGGCCCTGGCAGAACACACTCTTCT
TCGCCTTCTATCCTGCCGCTTAGCGTGTTCCGTGTGATAGTTCAAGTACAACCACACTCTTAAGTTGGT
CAAAAGAATGCTGGCTTCAGTTGTAATCAAAACTCCATCGCATCTAATCGTTCTGAGGAAATCATCCAA
GCAATGCAACTGGATTGTGTTTCAAGCAGGAGAGGAGAGGGAAGAGACGGAAGAACCATGTTAATTTTT
ATTCCAAACGATCTCGCAGTACTTCAAATTGTAGATCGCGCAGATGGCATCTCTCGCCCCACTGTGTT
GGTGAAAAAGCACAGCTAGATCAAAAGAAATGCGATTTTCAAGGTGCTCAACGGTGGCTTCCAGCAAAG
CCTCCACGCGCACATCCAAGAACAAAAGAATACCAAAAGAAGGGAGCATTTTCTAACTCCTCAATCATCA
```

Figure 67 continued

```
TATTACATTCCTGCACCATTCCCAGATAATTTTCAGCTTTCCAGCCTTGAATTATTCGTGTCAGTTCTT
GTGGTAAATCCAATCCACACATTACAAACAGGTCCCGGAGGGCGCCCTCCACCACCATTCTTAAACACA
CCCTCATAATGACAAAATATCTTGCTCCTGTGTCACCTGTAGCGAATTGAGAATGGCAACATCAATTGA
CATGCCCTTGGCTCTAAGTTCTTCTTTAAGTTCTAGTTGTAAAAACTCTCTCATATTATCACCAAACTG
CTTAGCCAGAAGCCCCCGGGAACAAGAGCAGGGGACGCTACAGTGCAGTACAAGCGCAGACCTCCCCA
ATTGGCTCCAGCAAAAACAAGATTGGAATAAGCATATTGGGAACCGCCAGTAATATCATCGAAGTTGCT
GGAAATATAATCAGGCAGAGTTTCTTGTAAAATTGAATAAAAGAAAATTTGCCAAAAAAACATTCAA
AACCTCTGGGATGCAAATGCAATAGGTTACCGCGCTGCGCTCCAACATTGTTAGTTTTGAATTAGTCTG
CAAAAATAAAAAAAAAAACAAGCGTCATATCATAGTAGCCTGACGAACAGATGGATAAATCAGTCTTTC
CATCACAAGACAAGCCACAGGGTCTCCAGCTCGACCCTCGTAAAACCTGTCATCATGATTAAACAACAG
CACCGAAAGTTCCTCGCGGTGACCAGCATGAATAATTCTTGATGAAGCATACAATCCAGACATGTTAGC
ATCAGTTAACGAGAAAAAACAGCCAACATAGCCTTTGGGTATAATTATGCTTAATCGTAAGTATAGCAA
AGCCACCCCTCGCGGATACAAAGTAAAAGGCACAGGAGAATAAAAAATATAATTATTTCTGCTGCTG
TTCAGGCAACGTCGCCCCCGGTCCCTCTAAATACACATACAAAGCCTCATCAGCCATGGCTTACCAGAC
AAAGTACAGCGGGCACACAAAGCACAAGCTCTAAAGTGACTCTCCAACCTCTCCACAATATATATATAC
ACAAGCCCTAAACTGACGTAATGGGAGTAAAGTGTAAAAAATCCCGCCAAACCCAACACACACCCCGAA
ACTGCGTCACCAGGGAAAAGTACAGTTTCACTTCCGCAATCCCAACAGGCGTAACTTCCTCTTTCTCAC
GGTACGTGATATCCCACTAACTTGCAACGTCATTTTCCCACGGTCGCACCGCCCCTTTTAGCCGTTAAC
CCCACAGCCAATCACCACACGATCCACACTTTTTAAAATCACCTCATTTACATATTGGCACCATTCCAT
CTATAAGGTATATTATATAGATAGA
```

Figure 68
SEQ ID NO: 105    NG-444-R in pUC57-Kan plasmid

```
TCGCGCGTTTCGGTGATGACGGTGAAAACCTCTGACACATGCAGCTCCCGGAGACGGTCACAGCTTGTC
TGTAAGCGGATGCCGGGAGCAGACAAGCCCGTCAGGGCGCGTCAGCGGGTGTTGGCGGGTGTCGGGGCT
GGCTTAACTATGCGGCATCAGAGCAGATTGTACTGAGAGTGCACCATATGCGGTGTGAAATACCGCACA
GATGCGTAAGGAGAAAATACCGCATCAGGCGCCATTCGCCATTCAGGCTGCGCAACTGTTGGGAAGGGC
GATCGGTGCGGGCCTCTTCGCTATTACGCCAGCTGGCGAAAGGGGGATGTGCTGCAAGGCGATTAAGTT
GGGTAACGCCAGGGTTTTCCCAGTCACGACGTTGTAAAACGACGGCCAGTGAATTGACGCGTATTGGGA
TGAATTCACATTGATTATTGACTAGTTATTAATAGTAATCAATTACGGGGTCATTAGTTCATAGCCCAT
ATATGGAGTTCCGCGTTACATAACTTACGGTAAATGGCCCGCCTGGCTGACCGCCCAACGACCCCCGCC
CATTGACGTCAATAATGACGTATGTTCCCATAGTAACGCCAATAGGGACTTTCCATTGACGTCAATGGG
TGGAGTATTTACGGTAAACTGCCCACTTGGCAGTACATCAAGTGTATCATATGCCAAGTACGCCCCCTA
TTGACGTCAATGACGGTAAATGGCCCGCCTGGCATTATGCCCAGTACATGACCTTATGGGACTTTCCTA
CTTGGCAGTACATCTACGTATTAGTCATCGCTATTACCATGGTGATGCGGTTTTGGCAGTACATCAATG
GGCGTGGATAGCGGTTTGACTCACGGGGATTTCCAAGTCTCCACCCCATTGACGTCAATGGGAGTTTGT
TTTGGCACCAAAATCAACGGGACTTTCCAAAATGTCGTAACAACTCCGCCCCATTGACGCAAATGGGCG
GTAGGCGTGTACGGTGGGAGGTCTATATAAGCAGAGCTCTCTGGCTAACTAGAGAACCCACTGCTTACT
GGCCCCACCATGGGATGGAGCTGTATCATCCTCTTCTTGGTAGCAACAGCTACAGGTGTCCACTCCCAG
GTGCAGCTGCAGCAGTCTGGGCTGAACTGGCAAGACCTGGGGCCTCAGTGAAGATGTCCTGCAAGGCT
TCTGGCTACACCTTTACTAGGTACACGATGCACTGGGTAAAACAGAGGCCTGGACAGGGTCTGGAATGG
ATTGGATACATTAATCCTAGCCGTGGTTATACTAATTACAATCAGAAGTTCAAGGACAAGGCCACATTG
ACTACAGACAAATCCTCCAGCACAGCCTACATGCAACTGAGCAGCCTGACATCTGAGGACTCTGCAGTC
TATTACTGTGCAAGATATTATGATGATCATTACTGCCTTGACTACTGGGGCCAAGGCACCACTCTCACA
GTCTCCTCAGGTGGCGGTGGCTCGGGCGGTGGTGGATCTGGTGGCGGCGGATCTGATATCGTGCTCACT
CAGTCTCCAGCAATCATGTCTGCATCTCCAGGGGAGAAGGTCACCATGACCTGCAGTGCCAGCTCAAGT
GTAAGTTACATGAACTGGTACCAGCAGAAGTCAGGCACCTCCCCAAAAGATGGATTTATGACACATCC
AAACTGGCTTCTGGAGTCCCTGCTCACTTCAGGGGCAGTGGGTCTGGGACCTCTTACTCTCTCACAATC
AGCGGCATGGAGGCTGAAGATGCTGCCACTTATTACTGCCAGCAGTGGAGTAGTAACCCATTCACGTTC
GGCTCGGGGACAAAGTTGGAAATAAACCGGGGATCCGAACAAAAACTCATCTCAGAAGAGGATCTGAAT
GCTGTGGGCCAGGACACGCAGGAGGTCATCGTGGTGCCACACTCCTTGCCCTTTAAGGTGGTGGTGATC
```

Figure 68 continued

```
TCAGCCATCCTGGCCCTGGTGGTGCTCACCATCATCTCCCTTATCATCCTCATCATGCTTTGGCAGAAG
AAGCCACGTGGAAGCGGAGCTACTAACTTCAGCCTGCTGAAGCAGGCTGGAGACGTGGAGGAGAACCCT
GGACCTGGCCACACACGGAGGCAGGGAACATCACCATCCAAGTGTCCATACCTCAATTTCTTTCAGCTC
TTGGTGCTGGCTGGTCTTTCTCACTTCTGTTCAGGTGTTATCCACGTGACCAAGGAAGTGAAAGAAGTG
GCAACGCTGTCCTGTGGTCACAATGTTTCTGTTGAAGAGCTGGCACAAACTCGCATCTACTGGCAAAAG
GAGAAGAAAATGGTGCTGACTATGATGTCTGGGACATGAATATATGGCCCGAGTACAAGAACCGGACC
ATCTTTGATATCACTAATAACCTCTCCATTGTGATCCTGGCTCTGCGCCCATCTGACGAGGGCACATAC
GAGTGTGTTGTTCTGAAGTATGAAAAGACGCTTTCAAGCGGGAACACCTGGCTGAAGTGACGTTATCA
GTCAAAGCTGACTTCCCTACACCTAGTATATCTGACTTTGAAATTCCAACTTCTAATATTAGAAGGATA
ATTTGCTCAACCTCTGGAGGTTTTCCAGAGCCTCACCTCTCCTGGTTGGAAAATGGAGAAGAATTAAAT
GCCATCAACACAACAGTTTCCCAAGATCCTGAAACTGAGCTCTATGCTGTTAGCAGCAAACTGGATTTC
AATATGACAACCAACCACAGCTTCATGTGTCTCATCAAGTATGGACATTTAAGAGTGAATCAGACCTTC
AACTGGAATACAACCAAGCAAGAGCATTTTCCTGATAACCTGCTCCCATCCTGGGCCATTACCTTAATC
TCAGTAAATGGAATTTTTGTGATATGCTGCCTGACCTACTGCTTTGCCCCAAGATGCAGAGAGAGAAGG
AGGAATGAGAGATTGAGAAGGGAAAGTGTACGCCCTGTATAAGCTAGCTTGACTGACTGAGATACAGCG
TACCTTCAGCTCACAGACATGATAAGATACATTGATGAGTTTGGACAAACCACAACTAGAATGCAGTGA
AAAAAATGCTTTATTTGTGAAATTTGTGATGCTATTGCTTTATTTGTAACCATTATAAGCTGCAATAAA
CAAGTTAACAACAACAATTGCATTCATTTATGTTTCAGGTTCAGGGGGAGGTGTGGGAGGTTTTTTAA
AGCAAGTAAAACCTCTACAAATGTGGTAGTCGTCAGCTATCCCGGGATCCCAATGGCGCGCCGAGCTTG
GCTCGAGCATGGTCATAGCTGTTTCCTGTGTGAAATTGTTATCCGCTCACAATTCCACACAACATACGA
GCCGGAAGCATAAAGTGTAAAGCCTGGGGTGCCTAATGAGTGAGCTAACTCACATTAATTGCGTTGCGC
TCACTGCCCGCTTTCCAGTCGGGAAACCTGTCGTGCCAGCTGCATTAATGAATCGGCCAACGCGCGGGG
AGAGGCGGTTTGCGTATTGGGCGCTCTTCCGCTTCCTCGCTCACTGACTCGCTGCGCTCGGTCGTTCGG
CTGCGGCGAGCGGTATCAGCTCACTCAAAGGCGGTAATACGGTTATCCACAGAATCAGGGGATAACGCA
GGAAAGAACATGTGAGCAAAAGGCCAGCAAAAGGCCAGGAACCGTAAAAAGGCCGCGTTGCTGGCGTTT
TTCCATAGGCTCCGCCCCCTGACGAGCATCACAAAAATCGACGCTCAAGTCAGAGGTGGCGAAACCCG
ACAGGACTATAAAGATACCAGGCGTTTCCCCCTGGAAGCTCCCTCGTGCGCTCTCCTGTTCCGACCCTG
CCGCTTACCGGATACCTGTCCGCCTTTCTCCCTTCGGGAAGCGTGGCGCTTTCTCATAGCTCACGCTGT
AGGTATCTCAGTTCGGTGTAGGTCGTTCGCTCCAAGCTGGGCTGTGTGCACGAACCCCCCGTTCAGCCC
GACCGCTGCGCCTTATCCGGTAACTATCGTCTTGAGTCCAACCCGGTAAGACACGACTTATCGCCACTG
GCAGCAGCCACTGGTAACAGGATTAGCAGAGCGAGGTATGTAGGCGGTGCTACAGAGTTCTTGAAGTGG
TGGCCTAACTACGGCTACACTAGAAGAACAGTATTTGGTATCTGCGCTCTGCTGAAGCCAGTTACCTTC
GGAAAAAGAGTTGGTAGCTCTTGATCCGGCAAACAAACCACCGCTGGTAGCGGTGGTTTTTTTGTTTGC
AAGCAGCAGATTACGCGCAGAAAAAAAGGATCTCAAGAAGATCCTTTGATCTTTTCTACGGGGTCTGAC
GCTCAGTGGAACGAAAACTCACGTTAAGGGATTTTGGTCATGAGATTATCAAAAGGATCTTCACCTAG
ATCCTTTTAAATTAAAAATGAAGTTTTAAATCAATCTAAAGTATATATGAGTAAACTTGGTCTGACAGT
TAGAAAAACTCATCGAGCATCAAATGAAACTGCAATTTATTCATATCAGGATTATCAATACCATATTTT
TGAAAAAGCCGTTTCTGTAATGAAGGAGAAAACTCACCGAGGCAGTTCCATAGGATGGCAAGATCCTGG
TATCGGTCTGCGATTCCGACTCGTCCAACATCAATACAACCTATTAATTTCCCTCGTCAAAAATAAGG
TTATCAAGTGAGAAATCACCATGAGTGACGACTGAATCCGGTGAGAATGGCAAAAGTTTATGCATTTCT
TTCCAGACTTGTTCAACAGGCCAGCCATTACGCTCGTCATCAAAATCACTCGCATCAACCAAACCGTTA
TTCATTCGTGATTGCGCCTGAGCGAGACGAAATACGCGATCGCTGTTAAAGGACAATTACAAACAGGA
ATCGAATGCAACCGGCGCAGGAACACTGCCAGCGCATCAACAATATTTTCACCTGAATCAGGATATTCT
TCTAATACCTGGAATGCTGTTTTCCCAGGGATCGCAGTGGTGAGTAACCATGCATCATCAGGAGTACGG
ATAAAATGCTTGATGGTCGGAAGAGGCATAAATTCCGTCAGCCAGTTTAGTCTGACCATCTCATCTGTA
ACATCATTGGCAACGCTACCTTTGCCATGTTTCAGAAACAACTCTGGCGCATCGGGCTTCCCATACAAT
CGATAGATTGTCGCACCTGATTGCCCGACATTATCGCGAGCCCATTTATACCCATATAAATCAGCATCC
ATGTTGGAATTTAATCGCGGCCTAGAGCAAGACGTTTCCCGTTGAATATGGCTCATACTCTTCCTTTTT
CAATATTATTGAAGCATTTATCAGGGTTATTGTCTCATGAGCGGATACATATTTGAATGTATTTAGAAA
AATAAACAAATAGGGGTTCCGCGCACATTTCCCCGAAAAGTGCCACCTGACGTCTAAGAAACCATTATT
ATCATGACATTAACCTATAAAAATAGGCGTATCACGAGGCCCTTTCGTC
```

Figure 69

SEQ ID NO: 106: 434-MVA-GFP+transgene

```
GCGCCCAATACGCAAACCGCCTCTCCCCGCGCGTTGGCCGATTCATTAATGCAGCTGGCACGACAGGTT
TCCCGACTGGAAAGCGGGCAGTGAGCGCAACGCAATTAATGTGAGTTAGCTCACTCATTAGGCACCCCA
GGCTTTACACTTTATGCTTCCGGCTCGTATGTTGTGTGGAATTGTGAGCGGATAACAATTTCACACAGG
AAACAGCTATGACCATGATTACGCCAAGCTTGCATGCATCTGGAAACGGGCATCTCCATTTAAGACTAG
ATGCCACGGGGTTTAAAATACTAATCATGACATTTTGTAGAGCGTAATTACTTAGTAAATCCGCCGTAC
TAGGTTCATTTCCTCCTCGTTTGGATCTCACATCAGAAATTAAAATAATCTTAGAAGGATGCAGTTGTT
TTTTGATGGATCGTAGATATTCCTCATCAACGAACCGAGTCACTAGAGTCACATCACGCAATCCATTTA
AAATAGGATCATGATGGCGGCCGTCAATTAGCATCCATTTGATGATCACTCCTAAATTATAGAAATGAT
CTCTCAAATAACGTATATGTGTACCGGGAGCAGATCCTATATACACTACGGTGGCACCATCTAATATAC
CGTGTCGCTGTAACTTACTAAGAAAAAATAATTCTCCTAGTAATAGTTTTAACTGTCCTTGATACGGTA
GTTTTTTTGCGACCTCATTTGCACTTTCTGGTTCGTAATCTAACTCATTATCAATTTCCTCAAAATACA
TAAACGGTTTATCTAACGACACAACATCCATTTTAAGTATTATATTAAAATTTAATCAATGTTTATTT
TTAGTTTTTTAGATAAAAATATAATATTATGAGTCGATGTAACACTTTCTACACACCGATTGATACAT
ATCATTACCTCCTATTATCTCTATCTCGGTTTCCTCACCCAATCGTTTAGAAAAGGAAGCCTCCTTAAA
GCATTTCATACACACAGCAGTTAGTTTTACCACCATTTCAGATAATGGAATAAGATTCAAAATATTATT
AAACGGTTTACGTTGAAATGTCCCATCGAGTGCGGCTACTATAACTATTTTCCTTCGTTTGCCATACA
GATCCTACGTACTCGAGCCCGGGATAGCTGACGACTACCACATTTGTAGAGGTTTTACTTGCTTTAAAA
AACCTCCCACACCTCCCCTGAACCTGAAACATAAAATGAATGCAATTGTTGTTGTTAACTTGTTTATT
GCAGCTTATAATGGTTACAAATAAAGCAATAGCATCACAAATTTCACAAATAAAGCATTTTTTCACTG
CATTCTAGTTGTGGTTTGTCCAAACTCATCAATGTATCTTATCATGTCTGTGAGCTGAAGGTACGCTGT
ATCTCAGTCAGTCAAGCTAGCTTATACAGGGCGTACACTTTCCTTCTCAATCTCTCATTCCTCCTTCT
CTCTCTGCATCTTGGGGCAAAGCAGTAGGTCAGGCAGCATATCACAAAAATTCCATTTACTGAGATTAA
GGTAATGGCCCAGGATGGGAGCAGGTTATCAGGAAAATGCTCTTGCTTGGTTGTATTCCAGTTGAAGGT
CTGATTCACTCTTAAATGTCCATACTTGATGAGACACATGAAGCTGTGGTTGGTTGTCATATTGAAATC
CAGTTTGCTGCTAACAGCATAGAGCTCAGTTTCAGGATCTTGGGAAACTGTTGTTGATGGCATTTAA
TTCTTCTCCATTTTCCAACCAGGAGAGGTGAGGCTCTGGAAAACCTCCAGAGGTTGAGCAAATTATCCT
TCTAATATTAGAAGTTGGAATTTCAAAGTCAGATATACTAGGTGTAGGGAAGTCAGCTTTGACTGATAA
CGTCACTTCAGCCAGGTGTTCCCGCTTGAAAGCGTCTTTTTCATACTTCAGAACAACACACTCGTATGT
GCCCTCGTCAGATGGGCGCAGAGCCAGGATCACAATGGAGAGGTTATTAGTGATATCAAAGATGGTCCG
GTTCTTGTACTCGGGCCATATATTCATGTCCCCAGACATCATAGTCAGCACCATTTTCTTCTCCTTTTG
CCAGTAGATGCGAGTTTGTGCCAGCTCTTCAACAGAAACATTGTGACCACAGGACAGCGTTGCCACTTC
TTTCACTTCCTTGGTCACGTGGATAACACCTGAACAGAAGTGAGAAAGACCAGCCAGCACCAAGAGCTG
AAAGAAATTGAGGTATGGACACTTGGATGGTGATGTTCCCTGCCTCCGTGTGTGGCCAGGTCCAGGGTT
CTCCTCCACGTCTCCAGCCTGCTTCAGCAGGCTGAAGTTAGTAGCTCCGCTTCCACGTGGCTTCTTCTG
CCAAAGCATGATGAGGATGATAAGGGAGATGATGGTGAGCACCACCAGGGCCAGGATGGCTGAGATCAC
CACCACCTTAAAGGGCAAGGAGTGTGGCACCACGATGACCTCCTGCGTGTCCTGGCCCACAGCATTCAG
ATCCTCTTCTGAGATGAGTTTTTGTTCGGATCCCCGGTTTATTTCCAACTTTGTCCCGAGCCGAACGT
GAATGGGTTACTACTCCACTGCTGGCAGTAATAAGTGGCAGCATCTTCAGCCTCCATGCCGCTGATTGT
GAGAGAGTAAGAGGTCCCAGACCCACTGCCCCTGAAGTGAGCAGGGACTCCAGAAGCCAGTTTGGATGT
GTCATAAATCCATCTTTTGGGGGAGGTGCCTGACTTCTGCTGGTACCAGTTCATGTAACTTACACTTGA
GCTGGCACTGCAGGTCATGGTGACCTTCTCCCTGGAGATGCAGACATGATTGCTGGAGACTGAGTGAG
CACGATATCAGATCCGCCGCCACCAGATCCACCACCGCCCGAGCCACCGCCACCTGAGGAGACTGTGAG
AGTGGTGCCTTGGCCCCAGTAGTCAAGGCAGTAATGATCATCATAATATCTTGCACAGTAATAGACTGC
AGAGTCCTCAGATGTCAGGCTGCTCAGTTGCATGTAGGCTGTGCTGGAGGATTTGTCTGTAGTCAATGT
GGCCTTGTCCTTGAACTTCTGATTGTAATTAGTATAACCACGGCTAGGATTAATGTATCCAATCCATTC
CAGACCCTGTCCAGGCCTCTGTTTTACCCAGTGCATCGTGTACCTAGTAAAGGTGTAGCCAGAAGCCTT
GCAGGACATCTTCACTGAGGCCCCAGGTCTTGCCAGTTCAGCCCCAGACTGCTGCAGCTGCACCTGGGA
GTGGACACCTGTAGCTGTTGCTACCAAGAAGAGGATGATACAGCTCCATCCCATGGTGGGCTCGAGGGT
ACCGGATCTAGATGGGGATCCGTCACTGTTCTTTATGATTCTACTTCCTTACCGTGCAATAAATTAGAA
TATATTTTCTACTTTTACGAGAAATTAATTATTGTATTTATTATTTATGGGTGAAAAACTTACTATAAA
```

Figure 69 continued

```
AAGCGGGTGGGTTTGGAATTAGTGATCAGTTTATGTATATCGCAACTACCGGGCATATGGCTATCGACA
TCGAGAACATTACCCACATGATAAGAGATTGTATCAGTTTCGTAGTCTTGAGTATTGGTATTACTATAT
AGTATATAGATGTCGACCTGCAGGTCGACGAAGTTCCTATACTTTCTAGAGAATAGGAACTTCGCAGCC
AAGCTGGAATTCATCCACTTTGGATAAGAAATCTGCATGATAAATATATTGATATCCTACCACCTATTA
AAGTACCATTATCTAATAGCAATAAGATAGATAAACAAATGTTTTTTGATGAAGTTATTACGTGGATAA
ATATATATCTTCAGGAAAAGGGTATTATGTTACCAGATGATATAAGAGAACTCAGAGATGCTATTATTC
CTTAACTAGTTACGTCTCTTTAGGTACTTATTTTGATACGTTACAAGTAAAAACTATCAAATATAAAT
GGAATCTGATTCTAATATAGCGATTGAAGAGGATCCACCGGTCGCCACCATGGTGAGCAAGGGCGAGGA
GCTGTTCACCGGGGTGGTGCCCATCCTGGTCGAGCTGGACGGCGACGTAAACGGCCACAAGTTCAGCGT
GTCCGGCGAGGGCGAGGGCGATGCCACCTACGGCAAGCTGACCCTGAAGTTCATCTGCACCACCGGCAA
GCTGCCCGTGCCCTGGCCCACCCTCGTGACCACCCTGACCTACGGCGTGCAGTGCTTCAGCCGCTACCC
CGACCACATGAAGCAGCACGACTTCTTCAAGTCCGCCATGCCCGAAGGCTACGTCCAGGAGCGCACCAT
CTTCTTCAAGGACGACGGCAACTACAAGACCCGCGCCGAGGTGAAGTTCGAGGGCGACACCCTGGTGAA
CCGCATCGAGCTGAAGGGCATCGACTTCAAGGAGGACGGCAACATCCTGGGGCACAAGCTGGAGTACAA
CTACAACAGCCACAACGTCTATATCATGGCCGACAAGCAGAAGAACGGCATCAAGGTGAACTTCAAGAT
CCGCCACAACATCGAGGACGGCAGCGTGCAGCTCGCCGACCACTACCAGCAGAACACCCCCATCGGCGA
CGGCCCCGTGCTGCTGCCCGACAACCACTACCTGAGCACCCAGTCCGCCCTGAGCAAAGACCCCAACGA
GAAGCGCGATCACATGGTCCTGCTGGAGTTCGTGACCGCCGCCGGGATCACTCTCGGCATGGACGAGCT
GTACAAGTAAAGCGGCCGCGAAGTTCCTATACTTTCTAGAGAATAGGAACTTCAACAATGTCTGGAAAG
AACTGTCCTTCATCGATACCTATCACGGAGAAATCTGTAATTGATTCCAAGACATCACATAGTTTAGTT
GCTTCCAATGCTTCAAAATTATTCTTATCATGCGTCCATAGTCCCGTTCCGTATCTATTATCGTTAGAA
TATTTTATAGTCACGCATTTATATTGAGCTATTTGATAACGTCTAACTCGTCTAATTAATTCTGTACTT
TTACCTGAAAACATGGGGCCGATTATCAACTGAATATGTCCGCCGTTCATGATGACAATAAAGAATTAA
TTATTGTTCACTTTATTCGACTTTAATATATCCATACGTTAGAAAATGCGATATCGCGACGAGGATCT
ATGTATCTAACAGGATCTATTGCGGTGGTAGCTAGAGCTGATTCTTTTTTGAATCGCATCAAACTAATC
ACAAAGTCGAACAAATATCCTTTATTAAGTTTGACCCTTCCATCTGTAACAATAGGGACCTTGTTAAAC
AGTTTTTTAAAATCTTGAGAGTCTGTGAATTTTGTCAATTGTCTGTATTCCTCTGAAAGAGATTCATAA
CAATGACCCACGGCTTCTAATTTATTTTTTGATTGGATCAATAATAATAACAGAAAGTCTAGATATTGA
GTGATTTGCAATATATCAGATAATGAAGATTCATCATCTTGACTAGCCAAATACTTAAAAAATGAATCA
TCATCTGCGAAGAACATCGTTAAGAGATACTGGTTGTGATCCATTTATGAGCTCGCGAAAGCTTGGCAC
TGGCCGTCGTTTTACAACGTCGTGACTGGGAAAACCCTGGCGTTACCCAACTTAATCGCCTTGCAGCAC
ATCCCCCTTTCGCCAGCTGGCGTAATAGCGAAGAGGCCCGCACCGATCGCCCTTCCCAACAGTTGCGCA
GCCTGAATGGCGAATGGCGCCTGATGCGGTATTTTCTCCTTACGCATCTGTGCGGTATTTCACACCGCA
TATGGTGCACTCTCAGTACAATCTGCTCTGATGCCGCATAGTTAAGCCAGCCCCGACACCCGCCAACAC
CCGCTGACGCGCCCTGACGGGCTTGTCTGCTCCCGGCATCCGCTTACAGACAAGCTGTGACCGTCTCCG
GGAGCTGCATGTGTCAGAGGTTTTCACCGTCATCACCGAAACGCGCGAGACGAAAGGGCCTCGTGATAC
GCCTATTTTTATAGGTTAATGTCATGATAATAATGGTTTCTTAGACGTCAGGTGGCACTTTTCGGGGAA
ATGTGCGCGGAACCCCTATTTGTTTATTTTTCTAAATACATTCAAATATGTATCCGCTCATGAGACAAT
AACCCTGATAAATGCTTCAATAATATTGAAAAAGGAAGAGTATGAGTATTCAACATTTCCGTGTCGCCC
TTATTCCCTTTTTTGCGGCATTTGCCTTCCTGTTTTGCTCACCCAGAAACGCTGGTGAAAGTAAAAG
ATGCTGAAGATCAGTTGGGTGCACGAGTGGGTTACATCGAACTGGATCTCAACAGCGGTAAGATCCTTG
AGAGTTTTCGCCCCGAAGAACGTTTTCCAATGATGAGCACTTTTAAAGTTCTGCTATGTGGCGCGGTAT
TATCCCGTATTGACGCCGGGCAAGAGCAACTCGGTCGCCGCATACACTATTCTCAGAATGACTTGGTTG
AGTACTCACCAGTCACAGAAAAGCATCTTACGGATGGCATGACAGTAAGAGAATTATGCAGTGCTGCCA
TAACCATGAGTGATAACACTGCGGCCAACTTACTTCTGACAACGATCGGAGGACCGAAGGAGCTAACCG
CTTTTTTGCACAACATGGGGGATCATGTAACTCGCCTTGATCGTTGGGAACCGGAGCTGAATGAAGCCA
TACCAAACGACGAGCGTGACACCACGATGCCTGTAGCAATGGCAACAACGTTGCGCAAACTATTAACTG
GCGAACTACTTACTCTAGCTTCCCGGCAACAATTAATAGACTGGATGGAGGCGGATAAAGTTGCAGGAC
CACTTCTGCGCTCGGCCCTTCCGGCTGGCTGGTTTATTGCTGATAAATCTGGAGCCGGTGAGCGTGGGT
CTCGCGGTATCATTGCAGCACTGGGGCCAGATGGTAAGCCCTCCCGTATCGTAGTTATCTACACGACGG
GGAGTCAGGCAACTATGGATGAACGAAATAGACAGATCGCTGAGATAGGTGCCTCACTGATTAAGCATT
GGTAACTGTCAGACCAAGTTTACTCATATATACTTTAGATTGATTTAAAACTTCATTTTAATTTAAAA
```

Figure 69 continued

GGATCTAGGTGAAGATCCTTTTTGATAATCTCATGACCAAAATCCCTTAACGTGAGTTTTCGTTCCACT
GAGCGTCAGACCCCGTAGAAAAGATCAAAGGATCTTCTTGAGATCCTTTTTTTCTGCGCGTAATCTGCT
GCTTGCAAACAAAAAAACCACCGCTACCAGCGGTGGTTTGTTTGCCGGATCAAGAGCTACCAACTCTTT
TTCCGAAGGTAACTGGCTTCAGCAGAGCGCAGATACCAAATACTGTTCTTCTAGTGTAGCCGTAGTTAG
GCCACCACTTCAAGAACTCTGTAGCACCGCCTACATACCTCGCTCTGCTAATCCTGTTACCAGTGGCTG
CTGCCAGTGGCGATAAGTCGTGTCTTACCGGGTTGGACTCAAGACGATAGTTACCGGATAAGGCGCAGC
GGTCGGGCTGAACGGGGGGTTCGTGCACACAGCCCAGCTTGGAGCGAACGACCTACACCGAACTGAGAT
ACCTACAGCGTGAGCTATGAGAAAGCGCCACGCTTCCCGAAGGGAGAAAGGCGGACAGGTATCCGGTAA
GCGGCAGGGTCGGAACAGGAGAGCGCACGAGGGAGCTTCCAGGGGGAAACGCCTGGTATCTTTATAGTC
CTGTCGGGTTTCGCCACCTCTGACTTGAGCGTCGATTTTTGTGATGCTCGTCAGGGGGGCGGAGCCTAT
GGAAAAACGCCAGCAACGCGGCCTTTTTACGGTTCCTGGCCTTTTGCTGGCCTTTTGCTCACATGTTCT
TTCCTGCGTTATCCCCTGATTCTGTGGATAACCGTATTACCGCCTTTGAGTGAGCTGATACCGCTCGCC
GCAGCCGAACGACCGAGCGCAGCGAGTCAGTGAGCGAGGAAGCGGAAGA

Figure 70
SEQ ID NO 107:   1863-MVA-GFP+transgene

GCGCCCAATACGCAAACCGCCTCTCCCCGCGCGTTGGCCGATTCATTAATGCAGCTGGCACGACAGGTT
TCCCGACTGGAAAGCGGGCAGTGAGCGCAACGCAATTAATGTGAGTTAGCTCACTCATTAGGCACCCCA
GGCTTTACACTTTATGCTTCCGGCTCGTATGTTGTGTGGAATTGTGAGCGGATAACAATTTCACACAGG
AAACAGCTATGACCATGATTACGCCAAGCTTGCATGCATCTGGAAACGGGCATCTCCATTTAAGACTAG
ACGCCACGGGGTTTAAAATACTAATCATGACATTTTGTAGAGCGTAATTACTTAGTAAATCCGCCGTAC
TAGGTTCATTTCCTCCTCGTTTGGATCTCACATCAGAAATTAAAATAATCTTAGAAGGATGCAGTTGTT
TTTTGATGGATCGTAGATATTCCTCATCAACGAACCGAGTCACTAGAGTCACATCACGCAATCCATTTA
AAATAGGATCATGATGGCGGCCGTCAATTAGCATCCATTTGATGATCACTCCTAAATTATAGAAATGAT
CTCTCAAATAACGTATATGTGTACCGGGAGCAGATCCTATATACACTACGGTGGCACCATCTAATATAC
CGTGTCGCTGTAACTTACTAAGAAAAATAATTCTCCTAGTAATAGTTTTAACTGTCCTTGATACGGCA
GTTTTTTTGCGACCTCATTTGCACTTTCTGGTTCGTAATCTAACTCATTATCAATTTCCTCAAAATACA
TAAACGGTTTATCTAACGACACAACATCCATTTTAAGTATTATATTAAAATTTAATCAATGTTTATTT
TTAGTTTTTTAGATAAAAAATATAATATTATGAGTCGATGTAACACTTTCTACACACCGATTGATACAT
ATCATTACCTCCTATTATTTCTATCTCGGTTTCCTCACCCAATCGTTTAGAAAAGGAAGCCTCCTTAAA
GCATTTCATACACACAGCAGTTAGTTTTACCACCATTTCAGATAATGGAATAAGATTCAAAATATTATT
AAACGGTTTACGTTGAAATGTCCCATCGAGTGCGGCTACTATAACTAATTTTTCCTTCGTTTGCCTACA
GATCCTACGTACTCGAGCCCGGGATAGCTGACGACTACCACATTTGTAGAGGTTTTACTTGCTTTAAAA
AACCTCCCACACCTCCCCCTGAACCTGAAACATAAAATGAATGCAATTGTTGTTGTTAACTTGTTTATT
GCAGCTTATAATGGTTACAAATAAAGCAATAGCATCACAAATTTCACAAATAAAGCATTTTTTTCACTG
CATTCTAGTTGTGGTTTGTCCAAACTCATCAATGTATCTTATCATGTCTGTGAGCTGAAGGTACGCTGT
ATCTCAGTCAGTCAAGCTAGCTTATACAGGGCGTACACTTTCCCTTCTCAATCTCTCATTCCTCCTTCT
CTCTCTGCATCTTGGGGCAAAGCAGTAGGTCAGGCAGCATATCACAAAAATTCCATTTACTGAGATTAA
GGTAATGGCCCAGGATGGGAGCAGGTTATCAGGAAAATGCTCTTGCTTGGTTGTATTCCAGTTGAAGGT
CTGATTCACTCTTAAATGTCCATACTTGATGAGACACATGAAGCTGTGGTTGGTTGTCATATTGAAATC
CAGTTTGCTGCTAACAGCATAGAGCTCAGTTTCAGGATCTTGGGAAACTGTTGTGTTGATGGCATTTAA
TTCTTCTCCATTTTCCAACCAGGAGAGGTGAGGCTCTGGAAAACCTCCAGAGGTTGAGCAAATTATCCT
TCTAATATTAGAAGTTGGAATTTCAAAGTCAGATATACTAGGTGTAGGGAAGTCAGCTTTGACTGATAA
CGTCACTTCAGCCAGGTGTTCCCGCTTGAAAGCGTCTTTTCATACTTCAGAACAACACACTCGTATGT
GCCCTCGTCAGATGGGCGCAGAGCCAGGATCACAATGGAGAGGTTATTAGTGATATCAAAGATGGTCCG
GTTCTTGTACTCGGCCATATATTCATGTCCCCAGACATCATAGTCAGCACCATTTTCTTCTCCTTTTG
CCAGTAGATGCGAGTTTGTGCCAGCTCTTCAACAGAAACATTGTGACCACAGGACAGCGTTGCCACTTC
TTTCACTTCCTTGGTCACGTGGATAACACCTGAACAGAAGTGAGAAAGACCAGCCAGCACCAAGAGCTG
AAAGAAATTGAGGTATGGACACTTGGATGGTGATGTTCCCTGCCTCCGTGTGTGGCCAGGTCCAGGGTT
CTCCTCCACGTCTCCAGCCTGCTTCAGCAGGCTGAAGTTAGTAGCTCCGCTTCCACGTGGCTTCTTCTG
CCAAAGCATGATGAGGATGATAAGGGAGATGATGGTGAGCACCACCAGGGCCAGGATGGCTGAGATCAC
CACCACCTTAAAGGGCAAGGAGTGTGGCACCACGATGACCTCCTGCGTGTCCTGGCCCACAGCATTCAG
ATCCTCTTCTGAGATGAGTTTTGTTCGGATCCCCGGTTTATTTCCAACTTTGTCCCCGAGCCGAACGT
GAATGGGTTACTACTCCACTGCTGGCAGTAATAAGTGGCAGCATCTTCAGCCTCCATGCCGCTGATTGT
GAGAGAGTAAGAGGTCCCAGACCCACTGCCCCTGAAGTGAGCAGGGACTCCAGAAGCCAGTTTGGATGT

Figure 70 continued

```
GTCATAAATCCATCTTTTGGGGGAGGTGCCTGACTTCTGCTGGTACCAGTTCATGTAACTTACACTTGA
GCTGGCACTGCAGGTCATGGTGACCTTCTCCCCTGGAGATGCAGACATGATTGCTGGAGACTGAGTGAG
CACGATATCAGATCCGCCGCCACCAGATCCACCACCGCCCGAGCCACCGCCACCTGAGGAGACTGTGAG
AGTGGTGCCTTGGCCCCAGTAGTCAAGGCAGTAATGATCATCATAATATCTTGCACAGTAATAGACTGC
AGAGTCCTCAGATGTCAGGCTGCTCAGTTGCATGTAGGCTGTGCTGGAGGATTTGTCTGTAGTCAATGT
GGCCTTGTCCTTGAACTTCTGATTGTAATTAGTATAACCACGGCTAGGATTAATGTATCCAATCCATTC
CAGACCCTGTCCAGGCCTCTGTTTTACCCAGTGCATCGTGTACCTAGTAAAGGTGTAGCCAGAAGCCTT
GCAGGACATCTTCACTGAGGCCCCAGGTCTTGCCAGTTCAGCCCCAGACTGCTGCAGCTGCACCTGGGA
GTGGACACCTGTAGCTGTTGCTACCAAGAAGAGGATGATACAGCTCCATCCCATGGTGGGCTCGAGGCG
GCCGCGGTACCGGATCCTACGATACAAACTTAACGGATATCGCGATAATGAAATTATTTATGATTATTT
CTCGCTTTCAATTTAACACAACCCTCAAGAACCTTTGTATTTATTTTCAATTTTTCTGCAGGTCGACGA
AGTTCCTATACTTTCTAGAGAATAGGAACTTCGCAGCCAAGCTGGAATTCATCCACTTTGGATAAGAAA
TCTGCATGATAAATATATTGATATCCTACCACCTATTAAAGTACCATTATCTAATAGCAATAAGATAGA
TAAACAAATGTTTTTTGATGAAGTTATTACGTGGATAAATATATATCTTCAGGAAAAGGGTATTATGTT
ACCAGATGATATAAGAGAACTCAGAGATGCTATTATTCCTTAACTAGTTACGTCTCTTTAGGTACTTAT
TTTGATACGTTACAAGTAAAAAACTATCAAATATAAATGGAATCTGATTCTAATATAGCGATTGAAGAG
GATCCACCGGTCGCCACCATGGTGAGCAAGGGCGAGGAGCTGTTCACCGGGGTGGTGCCCATCCTGGTC
GAGCTGGACGGCGACGTAAACGGCCACAAGTTCAGCGTGTCCGGCGAGGGCGAGGGCGATGCCACCTAC
GGCAAGCTGACCCTGAAGTTCATCTGCACCACCGGCAAGCTGCCCGTGCCCTGGCCCACCCTCGTGACC
ACCCTGACCTACGGCGTGCAGTGCTTCAGCCGCTACCCCGACCACATGAAGCAGCACGACTTCTTCAAG
TCCGCCATGCCCGAAGGCTACGTCCAGGAGCGCACCATCTTCTTCAAGGACGACGGCAACTACAAGACC
CGCGCCGAGGTGAAGTTCGAGGGCGACACCCTGGTGAACCGCATCGAGCTGAAGGGCATCGACTTCAAG
GAGGACGGCAACATCCTGGGGCACAAGCTGGAGTACAACTACAACAGCCACAACGTCTATATCATGGCC
GACAAGCAGAAGAACGGCATCAAGGTGAACTTCAAGATCCGCCACAACATCGAGGACGGCAGCGTGCAG
CTCGCCGACCACTACCAGCAGAACACCCCCATCGGCGACGGCCCCGTGCTGCTGCCCGACAACCACTAC
CTGAGCACCCAGTCCGCCCTGAGCAAAGACCCCAACGAGAAGCGCGATCACATGGTCCTGCTGGAGTTC
GTGACCGCCGCCGGGATCACTCTCGGCATGGACGAGCTGTACAAGTAAAGCGGCCGCGAAGTTCCTATA
CTTTCTAGAGAATAGGAACTTCAACAATGTCTGGAAAGAACTGTCCTTCATCGATACCTATCACGGAGA
AATCTGTAATTGATTCCAAGAGATCACATAGTTTAGTTGCTTCCAATGCTTCAAAATTATTCTTATCAT
GCGTCCATAGTCCCGTTCCGTATCTATTATCGTTAGAATATTTTATAGTCACGCATTTATATTGAGCTA
TTTGATAACGTCTAACTCGTCTAATTAATTCTGTACTTTTACCTGAAAACATGGGGCCGATTATCAACT
GAATATGTCCGCCGTTCATGATGACAATAAAGAATTAATTATTGTTCACTTTATTCGACTTTAATATAT
CCATCACGTTAGAAAATGCGATATTGCGACGAGGATCTATGTATCTAACAGGATCTATTGCGGTGGTAG
CTAGAGAGGATTCTTTTTTGAATCGCATCAAACTAATCACAAAGTCGAACAAATATCCTTTATTAAGTT
TGACCCTTCCATCTGTAACAATAGGGACCTTGTTAAACAGTTTTTTAAAATCTTGAAAGTCTGTGAATT
TTGTCAATTGTCTGTATTCCTCTGAAAGAGATTCATAACAATGACCCACGGCTTCTAATTTATTTTTTG
ATTGGATCAATAATAATAACAGAAAGTCTAGATATTGAGTGATTTGCAATATATCAGATAATGAAGATT
TCATCATCTTGACTAGCCAAATACTTAAAAAATGAATCATCATCTGCGAAGAACATCGTTAAGAGATAC
TGGTTGTGATCCATTTATGAGCTCGCGAAAGCTTGGCACTGGCCGTCGTTTTACAACGTCGTGACTGGG
AAAACCCTGGCGTTACCCAACTTAATCGCCTTGCAGCACATCCCCCTTTCGCCAGCTGGCGTAATAGCG
AAGAGGCCCGCACCGATCGCCCTTCCCAACAGTTGCGCAGCCTGAATGGCGAATGGCGCCTGATGCGGT
ATTTTCTCCTTACGCATCTGTGCGGTATTTCACACCGCATATGGTGCACTCTCAGTACAATCTGCTCTG
ATGCCGCATAGTTAAGCCAGCCCCGACACCCGCCAACACCCGCTGACGCGCCCTGACGGGCTTGTCTGC
TCCCGGCATCCGCTTACAGACAAGCTGTGACCGTCTCCGGGAGCTGCATGTGTCAGAGGTTTTCACCGT
CATCACCGAAACGCGCGAGACGAAAGGGCCTCGTGATACGCCTATTTTATAGGTTAATGTCATGATAA
TAATGGTTTCTTAGACGTCAGGTGGCACTTTTCGGGGAAATGTGCGCGGAACCCCTATTTGTTTATTTT
TCTAAATACATTCAAATATGTATCCGCTCATGAGACAATAACCCTGATAAATGCTTCAATAATATTGAA
AAAGGAAGAGTATGAGTATTCAACATTTCCGTGTCGCCCTTATTCCCTTTTTTGCGGCATTTTGCCTTC
CTGTTTTTGCTCACCCAGAAACGCTGGTGAAAGTAAAAGATGCTGAAGATCAGTTGGGTGCACGAGTGG
GTTACATCGAACTGGATCTCAACAGCGGTAAGATCCTTGAGAGTTTTCGCCCCGAAGAACGTTTTCCAA
TGATGAGCACTTTTAAAGTTCTGCTATGTGGCGCGGTATTATCCCGTATTGACGCCGGGCAAGAGCAAC
TCGGTCGCCGCATACACTATTCTCAGAATGACTTGGTTGAGTACTCACCAGTCACAGAAAAGCATCTTA
CGGATGGCATGACAGTAAGAGAATTATGCAGTGCTGCCATAACCATGAGTGATAACACTGCGGCCAACT
TACTTCTGACAACGATCGGAGGACCGAAGGAGCTAACCGCTTTTTGCACAACATGGGGGATCATGTAA
CTCGCCTTGATCGTTGGGAACCGGAGCTGAATGAAGCCATACCAAACGACGAGCGTGACACCACGATGC
CTGTAGCAATGGCAACAACGTTGCGCAAACTATTAACTGGCGAACTACTTACTCTAGCTTCCCGGCAAC
```

Figure 70 continued

```
AATTAATAGACTGGATGGAGGCGGATAAAGTTGCAGGACCACTTCTGCGCTCGGCCCTTCCGGCTGGCT
GGTTTATTGCTGATAAATCTGGAGCCGGTGAGCGTGGGTCTCGCGGTATCATTGCAGCACTGGGGCCAG
ATGGTAAGCCCTCCCGTATCGTAGTTATCTACACGACGGGGAGTCAGGCAACTATGGATGAACGAAATA
GACAGATCGCTGAGATAGGTGCCTCACTGATTAAGCATTGGTAACTGTCAGACCAAGTTTACTCATATA
TACTTTAGATTGATTTAAAACTTCATTTTTAATTTAAAAGGATCTAGGTGAAGATCCTTTTTGATAATC
TCATGACCAAAATCCCTTAACGTGAGTTTTCGTTCCACTGAGCGTCAGACCCCGTAGAAAAGATCAAAG
GATCTTCTTGAGATCCTTTTTTTCTGCGCGTAATCTGCTGCTTGCAAACAAAAAAACCACCGCTACCAG
CGGTGGTTTGTTTGCCGGATCAAGAGCTACCAACTCTTTTTCCGAAGGTAACTGGCTTCAGCAGAGCGC
AGATACCAAATACTGTCCTTCTAGTGTAGCCGTAGTTAGGCCACCACTTCAAGAACTCTGTAGCACCGC
CTACATACCTCGCTCTGCTAATCCTGTTACCAGTGGCTGCTGCCAGTGGCGATAAGTCGTGTCTTACCG
GGTTGGACTCAAGACGATAGTTACCGGATAAGGCGCAGCGGTCGGGCTGAACGGGGGGTTCGTGCACAC
AGCCCAGCTTGGAGCGAACGACCTACACCGAACTGAGATACCTACAGCGTGAGCTATGAGAAAGCGCCA
CGCTTCCCGAAGGGAGAAAGGCGGACAGGTATCCGGTAAGCGGCAGGGTCGGAACAGGAGAGCGCACGA
GGGAGCTTCCAGGGGGAAACGCCTGGTATCTTTATAGTCCTGTCGGGTTTCGCCACCTCTGACTTGAGC
GTCGATTTTTGTGATGCTCGTCAGGGGGCGGAGCCTATGGAAAAACGCCAGCAACGCGGCCTTTTTAC
GGTTCCTGGCCTTTTGCTGGCCTTTTGCTCACATGTTCTTTCCTGCGTTATCCCCTGATTCTGTGGATA
ACCGTATTACCGCCTTTGAGTGAGCTGATACCGCTCGCCGCAGCCGAACGACCGAGCGCAGCGAGTCAG
TGAGCGAGGAAGCGGAAGA
```

Figure 71

SEQ ID NO 108: 1864-MVA-GFP+transgene

```
GCGCCCAATACGCAAACCGCCTCTCCCCGCGCGTTGGCCGATTCATTAATGCAGCTGGCACGACAGGTT
TCCCGACTGGAAAGCGGGCAGTGAGCGCAACGCAATTAATGTGAGTTAGCTCACTCATTAGGCACCCCA
GGCTTTACACTTTATGCTTCCGGCTCGTATGTTGTGTGGAATTGTGAGCGGATAACAATTTCACACAGG
AAACAGCTATGACCATGATTACGCCAAGCTTGCATGCATCTGGAAACGGGCATCTCCATTTAAGACTAG
ATGCCACGGGGTTTAAAATACTAATCATGACATTTTGTAGAGCGTAATTACTTAGTAAATCCGCCGTAC
TAGGTTCATTTCCTCCTCGTTTGGATCTCACATCAGAAATTAAAATAATCTTAGAAGGATGCAGTTGTT
TTTTGATGGATCGTAGATATTCCTCATCAACGAACCGAGTCACTAGAGTCACATCACGCAATCCATTTA
AAATAGGATCATGATGGCGGCCGTCAATTAGCATCCATTTGATGATCACTCCTAAATTATAGAAATGAT
CTCTCAAATAACGTATATGTGTACCGGGAGCAGATCCTATATACACTACGGTGGCACCATCTAATATAC
CGTGTCGCTGTAACTTACTAAGAAAAATAATTCTCCTAGTAATAGTTTTAACTGTCCTTGATACGGTA
GTTTTTTTGCGACCTCATTTGCACTTTCTGGTTCGTAATCTAACTCATTATCAATTTCCTCAAAATACA
TAAACGGTTTATCTAACGACACAACATCCATTTTAAGTATTATATTAAAATTTAATCAATGTTTATTT
TTAGTTTTTTAGATAAAAAATATAATATTATGAGTCGATGTAACACTTTCTACACACCGATTGATACAT
ATCATTACCTCCTATTATTTCTATCTCGGTTTCCTCACCCAATCGTTTAGAAAAGGAAGCCTCCTTAAA
GCATTTCATACACACAGCAGTTAGTTTTACCACCATTTCAGATAATGGAATAAGATTCAAAATATTATT
AAACGGTTTACGTTGAAATGTCCCATCGAGTGCGGCTACTATAACTATTTTTCCTTCGTTTGCCATACA
GATCCTACGTACTCGAGCCCGGGATAGCTGACGACTACCACATTTGTAGAGGTTTTACTTGCTTTAAAA
AACCTCCCACACCTCCCCCTGAACCTGAAACATAAAATGAATGCAATTGTTGTTGTTAACTTGTTTATT
GCAGCTTATAATGGTTACAAATAAAGCAATAGCATCACAAATTTCACAAATAAAGCATTTTTTTCACTG
CATTCTAGTTGTGGTTTGTCCAAACTCATCAATGTATCTTATCATGTCTGTGAGCTGAAGGTACGCTGT
ATCTCAGTCAGTCAAGCTAGCTTATACAGGGCGTACACTTTCCCTTCTCAATCTCTCATTCCTCCTTCT
CTCTCTGCATCTTGGGGCAAAGCAGTAGGTCAGGCAGCATATCACAAAAATTCCATTTACTGAGATTAA
GGTAATGGCCCAGGATGGGAGCAGGTTATCAGGAAATGCTCTTGCTTGGTTGTATTCCAGTTGAAGGT
CTGATTCACTCTTAAATGTCCATACTTGATGAGACACATGAAGCTGTGGTTGGTTGTCATATTGAAATC
CAGTTTGCTGCTAACAGCATAGAGCTCAGTTTCAGGATCTTGGGAAACTGTTGTTGATGGCATTTAA
TTCTTCTCCATTTTCCAACCAGGAGAGGTGAGGCTCTGGAAAACCTCCAGAGGTTGAGCAAATTATCCT
TCTAATATTAGAAGTTGGAATTTCAAAGTCAGATATACTAGGTGTAGGGAAGTCAGCTTTGACTGATAA
CGTCACTTCAGCCAGGTGTTCCCGCTTGAAAGCGTCTTTTTCATACTTCAGAACAACACACTCGTATGT
GCCCTCGTCAGATGGGCGCAGAGCCAGGATCACAATGGAGAGGTTATTAGTGATATCAAAGATGGTCCG
GTTCTTGTACTCGGGCCATATATTCATGTCCCCAGACATCATAGTCAGCACCATTTTCTTCTCCTTTTG
CCAGTAGATGCGAGTTTGTGCCAGCTCTTCAACAGAAACATTGTGACCACAGGACAGCGTTGCCACTTC
TTTCACTTCCTTGGTCACGTGGATAACACCTGAACAGAAGTGAGAAAGACCAGCCAGCACCAAGAGCTG
AAAGAAATTGAGGTATGGACACTTGGATGGTGATGTTCCCTGCCTCCGTGTGTGGCCAGGTCCAGGGTT
CTCCTCCACGTCTCCAGCCTGCTTCAGCAGGCTGAAGTTAGTAGCTCCGCTTCCACGTGGCTTCTTCTG
CCAAAGCATGATGAGGATGATAAGGGAGATGATGGTGAGCACCACCAGGGCCAGGATGGCTGAGATCAC
```

Figure 71 continued

```
CACCACCTTAAAGGGCAAGGAGTGTGGCACCACGATGACCTCCTGCGTGTCCTGGCCCACAGCATTCAG
ATCCTCTTCTGAGATGAGTTTTTGTTCGGATCCCCGGTTTATTTCCAACTTTGTCCCGAGCCGAACGT
GAATGGGTTACTACTCCACTGCTGGCAGTAATAAGTGGCAGCATCTTCAGCCTCCATGCCGCTGATTGT
GAGAGAGTAAGAGGTCCCAGACCCACTGCCCCTGAAGTGAGCAGGGACTCCAGAAGCCAGTTTGGATGT
GTCATAAATCCATCTTTTGGGGAGGTGCCTGACTTCTGCTGGTACCAGTTCATGTAACTTACACTTGA
GCTGGCACTGCAGGTCATGGTGACCTTCTCCCCTGGAGATGCAGACATGATTGCTGGAGACTGAGTGAG
CACGATATCAGATCCGCCGCCACCAGATCCACCACCGCCCGAGCCACCGCCACCTGAGGAGACTGTGAG
AGTGGTGCCTTGGCCCCAGTAGTCAAGGCAGTAATGATCATCATAATATCTTGCACAGTAATAGACTGC
AGAGTCCTCAGATGTCAGGCTGCTCAGTTGCATGTAGGCTGTGCTGGAGGATTTGTCTGTAGTCAATGT
GGCCTTGTCCTTGAACTTCTGATTGTAATTAGTATAACCACGGCTAGGATTAATGTATCCAATCCATTC
CAGACCCTGTCCAGGCCTCTGTTTTACCCAGTGCATCGTGTACCTAGTAAAGGTGTAGCCAGAAGCCTT
GCAGGACATCTTCACTGAGGCCCCAGGTCTTGCCAGTTCAGCCCCAGACTGCTGCAGCTGCACCTGGGA
GTGGACACCTGTAGCTGTTGCTACCAAGAAGAGGATGATACAGCTCCATCCCATGGTGGGCTCGAGATA
AAAAGCGGCCTTGGCCGAGGCGGCCACGCGTAGGCCTAGATCTGGCCTTAATGGCCGGATCCGGTACCT
TATTTATATTCCAAAAAAAAAAATAAAATTTCAATTTTTACAAAAAGAATTCATCCACTTTGGATAAG
AAATCTGCATGATAAATATATTGATATCCTACCACCTATTAAAGTACCATTATCTAATAGCAATAAGAT
AGATAAACAAATGTTTTTTGATGAAGTTATTACGTGGATAAATATATATCTTCAGGAAAAGGGTATTAT
GTTACCAGATGATATAAGAGAACTCAGAGATGCTATTATTCCTTAACTAGTTACGTCTCTTTAGGTACT
TATTTTGATACGTTACAAGTAAAAAACTATCAAATATAAATGGAATCTGATTCTAATATAGCGATTGAA
GAGGATCCACCGGTCGCCACCATGGTGAGCAAGGGCGAGGAGCTGTTCACCGGGGTGGTGCCCATCCTG
GTCGAGCTGGACGGCGACGTAAACGGCCACAAGTTCAGCGTGTCCGGCGAGGGCGAGGGCGATGCCACC
TACGGCAAGCTGACCCTGAAGTTCATCTGCACCACCGGCAAGCTGCCCGTGCCCTGGCCCACCCTCGTG
ACCACCCTGACCTACGGCGTGCAGTGCTTCAGCCGCTACCCCGACCACATGAAGCAGCACGACTTCTTC
AAGTCCGCCATGCCCGAAGGCTACGTCCAGGAGCGCACCATCTTCTTCAAGGACGACGGCAACTACAAG
ACCCGCGCCGAGGTGAAGTTCGAGGGCGACACCCTGGTGAACCGCATCGAGCTGAAGGGCATCGACTTC
AAGGAGGACGGCAACATCCTGGGGCACAAGCTGGAGTACAACTACAACAGCCACAACGTCTATATCATG
GCCGACAAGCAGAAGAACGGCATCAAGGTGAACTTCAAGATCCGCCACAACATCGAGGACGGCAGCGTG
CAGCTCGCCGACCACTACCAGCAGAACACCCCCATCGGCGACGGCCCCGTGCTGCTGCCCGACAACCAC
TACCTGAGCACCCAGTCCGCCCTGAGCAAAGACCCCAACGAGAAGCGCGATCACATGGTCCTGCTGGAG
TTCGTGACCGCCGCCGGGATCACTCTCGGCATGGACGAGCTGTACAAGTAAAGCGGCCGCGAAGTTCCT
ATACTTTCTAGAGAATAGGAACTTCAACAATGTCTGGAAAGAACTGTCCTTCATCGATACCTATCACGG
AGAAATCTGTAATTGATTCCAAGACATCACATAGTTTAGTTGCTTCCAATGCTTCAAAATTATTCTTAT
CATGCGTCCATAGTCCCGTTCCGTATCTATTATCGTTAGAATATTTTATAGTCACGCATTTATATTGAG
CTATTTGATAACGTCTAACTCGTCTAATTAATTCTGTACTTTTACCTGAAAACATGGGGCCGATTATCA
ACTGAATATGTCCGCCGTTCATGATGACAATAAAGAATTAATTATTGTTCACTTTATTCGACTTTAATA
TATCCATCACGTTAGAAAATGCGATATCGCGACGAGGATCTATGTATCTAACAGGATCTATTGCGGTGG
TAGCTAGAGCTGATTCTTTTTGAATCGCATCAAACTAATCACAAAGTCGAACAAATATCCTTTATTAA
GTTTGACCCTTCCATCTGTAACAATAGGGACCTTGTTAAACAGTTTTTTAAAATCTTGAGAGTCTGTGA
ATTTTGTCAATTGTCTGTATTCCTCTGAAAGAGATTCATAACAATGACCCACGGCTTCTAATTTATTTT
TTGATTGGATCAATAATAATAACAGAAAGTCTAGATATTGAGTGATTTGCAATATATCAGATAATGAAG
ATTCATCATCTTGACTAGCCAAATACTTAAAAAATGAATCATCATCTGCGAAGAACATCGTTAAGAGAT
ACTGGTTGTGATCCATTTATGAGCTCGCGAAAGCTTGGCACTGGCCGTCGTTTTACAACGTCGTGACTG
GGAAAACCCTGGCGTTACCCAACTTAATCGCCTTGCAGCACATCCCCCTTTCGCCAGCTGGCGTAATAG
CGAAGAGGCCCGCACCGATCGCCCTTCCCAACAGTTGCGCAGCCTGAATGGCGAATGGCGCCTGATGCG
GTATTTTCTCCTTACGCATCTGTGCGGTATTTCACACCGCATATGGTGCACTCTCAGTACAATCTGCTC
TGATGCCGCATAGTTAAGCCAGCCCCGACACCCGCCAACACCCGCTGACGCGCCCTGACGGGCTTGTCT
GCTCCCGGCATCCGCTTACAGACAAGCTGTGACCGTCTCCGGGAGCTGCATGTGTCAGAGGTTTTCACC
GTCATCACCGAAACGCGCGAGACGAAAGGGCCTCGTGATACGCCTATTTTTATAGGTTAATGTCATGAT
AATAATGGTTTCTTAGACGTCAGGTGGCACTTTTCGGGGAAATGTGCGCGGAACCCCTATTTGTTTATT
TTTCTAAATACATTCAAATATGTATCCGCTCATGAGACAATAACCCTGATAAATGCTTCAATAATATTG
AAAAAGGAAGAGTATGAGTATTCAACATTTCCGTGTCGCCCTTATTCCCTTTTTTGCGGCATTTTGCCT
TCCTGTTTTTGCTCACCCAGAAACGCTGGTGAAAGTAAAAGATGCTGAAGATCAGTTGGGTGCACGAGT
GGGTTACATCGAACTGGATCTCAACAGCGGTAAGATCCTTGAGAGTTTTCGCCCCGAAGAACGTTTTCC
AATGATGAGCACTTTTAAAGTTCTGCTATGTGGCGCGGTATTATCCCGTATTGACGCCGGGCAAGAGCA
ACTCGGTCGCCGCATACACTATTCTCAGAATGACTTGGTTGAGTACTCACCAGTCACAGAAAAGCATCT
TACGGATGGCATGACAGTAAGAGAATTATGCAGTGCTGCCATAACCATGAGTGATAACACTGCGGCCAA
```

Figure 71 continued

```
CTTACTTCTGACAACGATCGGAGGACCGAAGGAGCTAACCGCTTTTTTGCACAACATGGGGGATCATGT
AACTCGCCTTGATCGTTGGGAACCGGAGCTGAATGAAGCCATACCAAACGACGAGCGTGACACCACGAT
GCCTGTAGCAATGGCAACAACGTTGCGCAAACTATTAACTGGCGAACTACTTACTCTAGCTTCCCGGCA
ACAATTAATAGACTGGATGGAGGCGGATAAAGTTGCAGGACCACTTCTGCGCTCGGCCCTTCCGGCTGG
CTGGTTTATTGCTGATAAATCTGGAGCCGGTGAGCGTGGGTCTCGCGGTATCATTGCAGCACTGGGGCC
AGATGGTAAGCCCTCCCGTATCGTAGTTATCTACACGACGGGGAGTCAGGCAACTATGGATGAACGAAA
TAGACAGATCGCTGAGATAGGTGCCTCACTGATTAAGCATTGGTAACTGTCAGACCAAGTTTACTCATA
TATACTTTAGATTGATTTAAAACTTCATTTTTAATTTAAAAGGATCTAGGTGAAGATCCTTTTTGATAA
TCTCATGACCAAAATCCCTTAACGTGAGTTTTCGTTCCACTGAGCGTCAGACCCCGTAGAAAAGATCAA
AGGATCTTCTTGAGATCCTTTTTTTCTGCGCGTAATCTGCTGCTTGCAAACAAAAAAACCACCGCTACC
AGCGGTGGTTTGTTTGCCGGATCAAGAGCTACCAACTCTTTTTCCGAAGGTAACTGGCTTCAGCAGAGC
GCAGATACCAAATACTGTCCTTCTAGTGTAGCCGTAGTTAGGCCACCACTTCAAGAACTCTGTAGCACC
GCCTACATACCTCGCTCTGCTAATCCTGTTACCAGTGGCTGCTGCCAGTGGCGATAAGTCGTGTCTTAC
CGGGTTGGACTCAAGACGATAGTTACCGGATAAGGCGCAGCGGTCGGGCTGAACGGGGGGTTCGTGCAC
ACAGCCCAGCTTGGAGCGAACGACCTACACCGAACTGAGATACCTACAGCGTGAGCTATGAGAAAGCGC
CACGCTTCCCGAAGGGAGAAAGGCGGACAGGTATCCGGTAAGCGGCAGGGTCGGAACAGGAGAGCGCAC
GAGGGAGCTTCCAGGGGGAAACGCCTGGTATCTTTATAGTCCTGTCGGGTTTCGCCACCTCTGACTTGA
GCGTCGATTTTTGTGATGCTCGTCAGGGGGCGGAGCCTATGGAAAAACGCCAGCAACGCGGCCTTTT
ACGGTTCCTGGCCTTTTGCTGGCCTTTTGCTCACATGTTCTTTCCTGCGTTATCCCCTGATTCTGTGGA
TAACCGTATTACCGCCTTTGAGTGAGCTGATACCGCTCGCCGCAGCCGAACGACCGAGCGCAGCGAGTC
AGTGAGCGAGGAAGCGGAAGA
```
SEQ ID NO. 109 CMV promoter
```
AGTAATCAATTACGGGGTCATTAGTTCATAGCCCATATATGGAGTTCCGCGTTACATAACTTACGGTAA
ATGGCCCGCCTGGCTGACCGCCCAACGACCCCCGCCCATTGACGTCAATAATGACGTATGTTCCCATAG
TAACGCCAATAGGGACTTTCCATTGACGTCAATGGGTGGAGTATTTACGGTAAACTGCCCACTTGGCAG
TACATCAAGTGTATCATATGCCAAGTACGCCCCCTATTGACGTCAATGACGGTAAATGGCCCGCCTGGC
ATTATGCCCAGTACATGACCTTATGGGACTTTCCTACTTGGCAGTACATCTACGTATTAGTCATCGCTA
TTACCATGCTGATGCGGTTTTGGCAGTACATCAATGGGCGTGGATAGCGGTTTGACTCACGGGGATTTC
CAAGTCTCCACCCCATTGACGTCAATGGGAGTTTGTTTTGGCACCAAAATCAACGGGACTTTCCAAAAT
GTCGTAACAACTCCGCCCCATTGACGCAAATGGGCGGTAGGCGTGTACGGTGGGAGGTCTATATAAGCA
GAGCTGGTTTAGTGAACCGTCAGATCAGATCTTTGTCGATCCTACCATCCACTCGACACACCCGCCAGC
GGCCGCTGCCAAGCTTCCGAGCTCTCGAATTCAAAGGAGGTAC
```

Figure 72
SEQ ID NO. 110 Ad5-348 Genome
```
CATCATCAATAATATACCTTATTTTGGATTGAAGCCAATATGATAATGAGGGGGTGGAGTTTGTGACGT
GGCGCGGGGCGTGGGAACGGGGCGGGTGACGTAGTAGTGTGGCGGAAGTGTGATGTTGCAAGTGTGGCG
GAACACATGTAAGCGACGGATGTGGCAAAAGTGACGTTTTGGTGTGCGCCGGTGTACACAGGAAGTGA
CAATTTTCGCGCGGTTTTAGGCGGATGTTGTAGTAAATTTGGGCGTAACCGAGTAAGATTTGGCCATTT
TCGCGGGAAAACTGAATAAGAGGAAGTGAAATCTGAATAATTTTGTGTTACTCATAGCGCGTAATATTT
GTCTAGGGCCGCGGGGACTTTGACCGTTTACGTGGAGACTCGCCCAGGTGTTTTTCTCAGGTGTTTTCC
GCGTTCCGGGTCAAAGTTGGCGTTTTATTATTATAGTCAGCTGACGTGTAGTGTATTTATACCCGGTGA
GTTCCTCAAGAGGCCACTCTTGAGTGCCAGCGAGTAGAGTTTTCTCCTCCGAGCCGCTCCGACACCGGG
ACTGAAAATGAGACATATTATCTGCCACGGAGGTGTTATTACCGAAGAAATGGCCGCCAGTCTTTTGGA
CCAGCTGATCGAAGAGGTACTGGCTGATAATCTTCCACCTCCTAGCCATTTTGAACCACCTACCCTTCA
CGAACTGTATGATTTAGACGTGACGGCCCCCGAAGATCCCAACGAGGAGGCGGTTTCGCAGATTTTCC
CGACTCTGTAATGTTGGCGGTGCAGGAAGGGATTGACTTACTCACTTTTCCGCCGGCGCCCGGTTCTCC
GGAGCCGCCTCACCTTTCCCGGCAGCCCGAGCAGCCGGAGCAGAGAGCCTTGGGTCCGGTTTCTATGCC
AAACCTTGTACCGGAGGTGATCGATCTTACCTGCCACGAGGCTGGCTTTCCACCCAGTGACGACGAGGA
TGAAGAGGGTGAGGAGTTTGTGTTAGATTATGTGGAGCACCCCGGGCACGGTTGCAGGTCTTGTCATTA
TCACCGGAGGAATACGGGGGACCCAGATATTATGTGTTCGCTTTGCTATATGAGGACCTGTGGCATGTT
TGTCTACAGTAAGTGAAAATTATGGGCAGTGGGTGATAGAGTGGTGGGTTTGGTGTGGTAATTTTTTTT
TTAATTTTTACAGTTTTGTGGTTTAAAGAATTTTGTATTGTGATTTTTTAAAAGGTCCTGTGTCTGAA
```

Figure 72 continued

```
CCTGAGCCTGAGCCCGAGCCAGAACCGGAGCCTGCAAGACCTACCCGCCGTCCTAAAATGGCGCCTGCT
ATCCTGAGACGCCCGACATCACCTGTGTCTAGAGAATGCAATAGTAGTACGGATAGCTGTGACTCCGGT
CCTTCTAACACACCTCCTGAGATACACCCGGTGGTCCCGCTGTGCCCCATTAAACCAGTTGCCGTGAGA
GTTGGTGGGCGTCGCCAGGCTGTGGAATGTATCGAGGACTTGCTTAACGAGCCTGGGCAACCTTTGGAC
TTGAGCTGTAAACGCCCCAGGCCATAAGGTGTAAACCTGTGATTGCGTGTGTGGTTAACGCCTTTGTTT
GCTGAATGAGTTGATGTAAGTTTAATAAAGGGTGAGATAATGTTTAACTTGCATGGCGTGTTAAATGGG
GCGGGGCTTAAAGGGTATATAATGCGCCGTGGGCTAATCTTGGTTACATCTGACCTCATGGAGGCTTGG
GAGTGTTTGGAAGATTTTTCTGCTGTGCGTAACTTGCTGGAACAGAGCTCTAACAGTACCTCTTGGTTT
TGGAGGTTTCTGTGGGCTCATCCCAGGCAAAGTTAGTCTGCAGAATTAAGGAGGATTACAAGTGGGAA
TTTGAAGAGCTTTTGAAATCCTGTGGTGAGCTGTTTGATTCTTTGAATCTGGGTCACCAGGCGCTTTTC
CAAGAGAAGGTCATCAAGACTTTGGATTTTTCCACACCGGGGCGCGCTGCGGCTGCTGTTGCTTTTTG
AGTTTTATAAAGGATAAATGGAGCGAAGAAACCCATCTGAGCGGGGGGTACCTGCTGGATTTTCTGGCC
ATGCATCTGTGGAGAGCGGTTGTGAGACACAAGAATCGCCTGCTACTGTTGTCTTCCGTCCGCCCGGCG
ATAATACCGACGGAGGAGCAGCAGCAGCAGGAGGAAGCCAGGCGGCGGCGGCAGGAGCAGAGCCCA
TGGAACCCGAGAGCCGGCCTGGACCCTCGGGAATGAATGTTGTACAGGTGGCTGAACTGTATCCAGAAC
TGAGACGCATTTTGACAATTACAGAGGATGGGCAGGGGCTAAAGGGGGTAAAGAGGGAGCGGGGGGCTT
GTGAGGCTACAGAGGAGGCTAGGAATCTAGCTTTTAGCTTAATGACCAGACACCGTCCTGAGTGTATTA
CTTTTCAACAGATCAAGGATAATTGCGCTAATGAGCTTGATCTGCTGGCGCAGAAGTATTCCATAGAGC
AGCTGACCACTTACTGGCTGCAGCCAGGGGATGATTTTGAGGAGGCTATTAGGGTATATGCAAAGGTGG
CACTTAGGCCAGATTGCAAGTACAAGATCAGCAAACTTGTAAATATCAGGAATTGTTGCTACATTTCTG
GGAACGGGGCCGAGGTGGAGATAGATACGGAGGATAGGGTGGCCTTTAGATGTAGCATGATAAATATGT
GGCCGGGGGTGCTTGGCATGGACGGGGTGGTTATTATGAATGTAAGGTTTACTGGCCCCAATTTTAGCG
GTACGGTTTTCCTGGCCAATACCAACCTTATCCTACACGGTGTAAGCTTCTATGGGTTTAACAATACCT
GTGTGGAAGCCTGGACCGATGTAAGGGTTCGGGGCTGTGCCTTTTACTGCTGCTGGAAGGGGGTGGTGT
GTCGCCCCAAAAGCAGGGCTTCAATTAAGAAATGCCTCTTTGAAAGGTGTACCTTGGGTATCCTGTCTG
AGGGTAACTCCAGGGTGCGCCACAATGTGGCCTCCGACTGTGGTTGCTTCATGCTAGTGAAAAGCGTGG
CTGTGATTAAGCATAACATGGTATGTGGCAACTGCGAGGACAGGGCCTCTCAGATGCTGACCTGCTCGG
ACGGCAACTGTCACCTGCTGAAGACCATTCACGTAGCCAGCCACTCTCGCAAGGCCTGGCCAGTGTTTG
AGCATAACATACTGACCCGCTGTTCCTTGCATTTGGGTAACAGGAGGGGGGTGTTCCTACCTTACCAAT
GCAATTTGAGTCACACTAAGATATTGCTTGAGCCCGAGAGCATGTCCAAGGTGAACCTGAACGGGGTGT
TTGACATGACCATGAAGATCTGGAAGGTGCTGAGGTACGATGAGACCCGCACCAGGTGCAGACCCTGCG
AGTGTGGCGGTAAACATATTAGGAACCAGCCTGTGATGCTGGATGTGACCGAGGAGCTGAGGCCCGATC
ACTTGGTGCTGGCCTGCACCCGCGCTGAGTTTGGCTCTAGCGATGAAGATACAGATTGAGGTACTGAAA
TGTGTGGGCGTGGCTTAAGGGTGGGAAGAATATATAAGGTGGGGGTCTTATGTAGTTTTGTATCTGTT
TTGCAGCAGCCGCCGCCGCCATGAGCACCAACTCGTTTGATGGAAGCATTGTGAGCTCATATTTGACAA
CGCGCATGCCCCCATGGGCCGGGGTGCGTCAGAATGTGATGGGCTCCAGCATTGATGGTCGCCCCGTCC
TGCCCGCAAACTCTACTACCTTGACCTACGAGACCGTGTCTGGAACGCCGTTGGAGACTGCAGCCTCCG
CCGCCGCTTCAGCCGCTGCAGCCACCGCCCGCGGGATTGTGACTGACTTTGCTTTCCTGAGCCCGCTTG
CAAGCAGTGCAGCTTCCCGTTCATCCGCCCGCGATGACAAGTTGACGGCTCTTTTGGCACAATTGGATT
CTTTGACCCGGGAACTTAATGTCGTTTCTCAGCAGCTGTTGGATCTGCGCCAGCAGGTTTCTGCCCTGA
AGGCTTCCTCCCCTCCCAATGCGGTTTAAAACATAAATAAAAAACCAGACTCTGTTTGGATTTGGATCA
AGCAAGTGTCTTGCTGTCTTTATTAGGGGTTTTGCGCGCGCGGTAGGCCCGGGACCAGCGGTCTCGGT
CGTTGAGGGTCCTGTGTATTTTTCCAGGACGTGGTAAAGGTGACTCTGGATGTTCAGATACATGGGCA
TAAGCCCGTCTCTGGGGTGGAGGTAGCACCACTGCAGAGCTTCATGCTGCGGGGTGGTGTTGTAGATGA
TCCAGTCGTAGCAGGAGCGCTGGGCGTGGTGCCTAAAAATGTCTTTCAGTAGCAAGCTGATTGCCAGGG
GCAGGCCCTTGGTGTAAGTGTTTACAAAGCGGTTAAGCTGGGATGGGTGCATACGTGGGGATATGAGAT
GCATCTTGGACTGTATTTTAGGTTGGCTATGTTCCCAGCCATATCCCTCCGGGGATTCATGTTGTGCA
GAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCC
CACGGGCGGCGGCCTGGGCGAAGATATTTCTGGGATCACTAACGTCATAGTTGTGTTCCAGGATGAGAT
CGTCATAGGCCATTTTTACAAAGCGCGGGCGGAGGGTGCCAGACTGCGGTATAATGGTTCCATCCGGCC
CAGGGGCGTAGTTACCCTCACAGATTTGCATTTCCCACGCTTTGAGTTCAGATGGGGGGATCATGTCTA
```

Figure 72 continued

```
CCTGCGGGGCGATGAAGAAAACGGTTTCCGGGGTAGGGGAGATCAGCTGGGAAGAAAGCAGGTTCCTGA
GCAGCTGCGACTTACCGCAGCCGGTGGGCCCGTAAATCACACCTATTACCGGCTGCAACTGGTAGTTAA
GAGAGCTGCAGCTGCCGTCATCCCTGAGCAGGGGGGCCACTTCGTTAAGCATGTCCCTGACTCGCATGT
TTTCCCTGACCAAATCCGCCAGAAGGCGCTCGCCGCCCAGCGATAGCAGTTCTTGCAAGGAAGCAAAGT
TTTTCAACGGTTTGAGACCGTCCGCCGTAGGCATGCTTTTGAGCGTTTGACCAAGCAGTTCCAGGCGGT
CCCACAGCTCGGTCACCTGCTCTACGGCATCTCGATCCAGCATATCTCCTCGTTTCGCGGGTTGGGGCG
GCTTTCGCTGTACGGCAGTAGTCGGTGCTCGTCCAGACGGGCCAGGGTCATGTCTTTCCACGGGCGCAG
GGTCCTCGTCAGCGTAGTCTGGGTCACGGTGAAGGGGTGCGCTCCGGGCTGCGCGCTGGCCAGGGTGCG
CTTGAGGCTGGTCCTGCTGGTGCTGAAGCGCTGCCGGTCTTCGCCCTGCGCGTCGGCCAGGTAGCATTT
GACCATGGTGTCATAGTCCAGCCCCTCCGCGGCGTGGCCCTTGGCGCGCAGCTTGCCCTTGGAGGAGGC
GCCGCACGAGGGGCAGTGCAGACTTTTGAGGGCGTAGAGCTTGGGCGCGAGAAATACCGATTCCGGGGA
GTAGGCATCCGCGCCGCAGGCCCCGCAGACGGTCTCGCATTCCACGAGCCAGGTGAGCTCTGGCCGTTC
GGGGTCAAAAACCAGGTTTCCCCCATGCTTTTTGATGCGTTTCTTACCTCTGGTTTCCATGAGCCGGTG
TCCACGCTCGGTGACGAAAGGCTGTCCGTGTCCCGTATACAGACTTGAGAGGCCTGTCCTCGAGCGG
TGTTCCGCGGTCCTCCTCGTATAGAAACTCGGACCACTCTGAGACAAAGGCTCGCGTCCAGGCCAGCAC
GAAGGAGGCTAAGTGGGAGGGGTAGCGGTCGTTGTCCACTAGGGGGTCCACTCGCTCCAGGGTGTGAAG
ACACATGTCGCCCTCTTCGGCATCAAGGAAGGTGATTGGTTTGTAGGTGTAGGCCACGTGACCGGGTGT
TCCTGAAGGGGGGCTATAAAAGGGGGTGGGGGCGCGTTCGTCCTCACTCTCTTCCGCATCGCTGTCTGC
GAGGGCCAGCTGTTGGGGTGAGTACTCCCTCTGAAAAGCGGGCATGACTTCTGCGCTAAGATTGTCAGT
TTCCAAAAACGAGGAGGATTTGATATTCACCTGGCCCGCGGTGATGCCTTTGAGGGTGGCCGCATCCAT
CTGGTCAGAAAAGACAATCTTTTTGTTGTCAAGCTTGGTGGCAAACGACCCGTAGAGGGCGTTGGACAG
CAACTTGGCGATGGAGCGCAGGGTTTGGTTTTTGTCGCGATCGGCGCGCTCCTTGGCCGCGATGTTTAG
CTGCACGTATTCGCGCGCAACGCACCGCCATTCGGGAAAGACGGTGGTGCGCTCGTCGGGCACCAGGTG
CACGCGCCAACCGCGGTTGTGCAGGGTGACAAGGTCAACGCTGGTGGCTACCTCTCCGCGTAGGCGCTC
GTTGGTCCAGCAGAGGCGGCCGCCCTTGCGCGAGCAGAATGGCGGTAGGGGGTCTAGCTGCGTCTCGTC
CGGGGGGTCTGCGTCCACGGTAAAGACCCCGGGCAGCAGGCGCGCGTCGAAGTAGTCTATCTTGCATCC
TTGCAAGTCTAGCGCCTGCTGCCATGCGCGGGCGGCAAGCGCGCGCTCGTATGGGTTGAGTGGGGGACC
CCATGGCATGGGGTGGGTGAGCGCGGAGGCGTACATGCCGCAAATGTCGTAAACGTAGAGGGGCTCTCT
GAGTATTCCAAGATATGTAGGGTAGCATCTTCCACCGCGGATGCTGGCGCGCACGTAATCGTATAGTTC
GTGCGAGGGAGCGAGGAGGTCGGGACCGAGGTTGCTACGGGCGGGCTGCTCTGCTCGGAAGACTATCTG
CCTGAAGATGGCATGTGAGTTGGATGATATGGTTGGACGCTGGAAGACGTTGAAGCTGGCGTCTGTGAG
ACCTACCGCGTCACGCACGAAGGAGGCGTAGGAGTCGCGCAGCTTGTTGACCAGCTCGGCGGTGACCTG
CACGTCTAGGGCGCAGTAGTCCAGGGTTTCCTTGATGATGTCATACTTATCCTGTCCCTTTTTTTTCCA
CAGCTCGCGGTTGAGGACAAACTCTTCGCGGTCTTTCCAGTACTCTTGGATCGGAAACCCGTCGGCCTC
CGAACGGTAAGAGCCTAGCATGTAGAACTGGTTGACGGCCTGGTAGGCGCAGCATCCCTTTTCTACGGG
TAGCGCGTATGCCTGCGCGGCCTTCCGGAGCGAGGTGTGGGTGAGCGCAAAGGTGTCCCTGACCATGAC
TTTGAGGTACTGGTATTTGAAGTCAGTGTCGTCGCATCCGCCCTGCTCCCAGAGCAAAAAGTCCGTGCG
CTTTTTGGAACGCGGATTTGGCAGGGCGAAGGTGACATCGTTGAAGAGTATCTTTCCCGCGCGAGGCAT
AAAGTTGCGTGTGATGCGGAAGGGTCCCGGCACCTCGGAACGGTTGTTAATTACCTGGGCGGCGAGCAC
GATCTCGTCAAAGCCGTTGATGTTGTGGCCCACAATGTAAAGTTCCAAGAAGCGCGGGATGCCCTTGAT
GGAAGGCAATTTTTTAAGTTCCTCGTAGGTGAGCTCTTCAGGGGAGCTGAGCCCGTGCTCTGAAAGGGC
CCAGTCTGCAAGATGAGGGTTGGAAGCGACGAATGAGCTCCACAGGTCACGGGCCATTAGCATTTGCAG
GTGGTCGCGAAAGGTCCTAAACTGGCGACCTATGGCCATTTTTCTGGGGTGATGCAGTAGAAGGTAAG
CGGGTCTTGTTCCCAGCGGTCCCATCCAAGGTTCGCGGCTAGGTCTCGCGCGGCAGTCACTAGAGGCTC
ATCTCCGCCGAACTTCATGACCAGCATGAAGGGCACGAGCTGCTTCCCAAAGGCCCCCATCCAAGTATA
GGTCTCTACATCGTAGGTGACAAAGAGACGCTCGGTGCGAGGATGCGAGCCGATCGGGAAGAACTGGAT
CTCCCGCCACCAATTGGAGGAGTGGCTATTGATGTGGTGAAAGTAGAAGTCCCTGCGACGGGCCGAACA
CTCGTGCTGGCTTTTGTAAAAACGTGCGCAGTACTGGCAGCGGTGCACGGGCTGTACATCCTGCACGAG
GTTGACCTGACGACCGCGCACAAGGAAGCAGAGTGGGAATTTGAGCCCCTCGCCTGGCGGGTTTGGCTG
GTGGTCTTCTACTTCGGCTGCTTGTCCTTGACCGTCTGGCTGCTCGAGGGGAGTTACGGTGGATCGGAC
CACCACGCCGCGCGAGCCCAAAGTCCAGATGTCCGCGCGCGGCGGTCGGAGCTTGATGACAACATCGCG
CAGATGGGAGCTGTCCATGGTCTGGAGCTCCCGCGGCGTCAGGTCAGGCGGGAGCTCCTGCAGGTTTAC
```

Figure 72 continued

```
CTCGCATAGACGGGTCAGGGCGCGGGCTAGATCCAGGTGATACCTAATTTCCAGGGGCTGGTTGGTGGC
GGCGTCGATGGCTTGCAAGAGGCCGCATCCCCGCGGCGCGACTACGGTACCGCGCGGCGGGCGGTGGGC
CGCGGGGGTGTCCTTGGATGATGCATCTAAAAGCGGTGACGCGGGCGAGCCCCCGGAGGTAGGGGGGGC
TCCGGACCCGCCGGGAGAGGGGGCAGGGGCACGTCGGCGCCGCGCGCGGGCAGGAGCTGGTGCTGCGCG
CGTAGGTTGCTGGCGAACGCGACGACGCGGCGGTTGATCTCCTGAATCTGGCGCCTCTGCGTGAAGACG
ACGGGCCCGGTGAGCTTGAACCTGAAAGAGAGTTCGACAGAATCAATTTCGGTGTCGTTGACGGCGGCC
TGGCGCAAAATCTCCTGCACGTCTCCTGAGTTGTCTTGATAGGCGATCTCGGCCATGAACTGCTCGATC
TCTTCCTCCTGGAGATCTCCGCGTCCGGCTCGCTCCACGGTGGCGGCGAGGTCGTTGGAAATGCGGGCC
ATGAGCTGCGAGAAGGCGTTGAGGCCTCCCTCGTTCCAGACGCGGCTGTAGACCACGCCCCCTTCGGCA
TCGCGGGCGCGCATGACCACCTGCGCGAGATTGAGCTCCACGTGCCGGGCGAAGACGGCGTAGTTTCGC
AGGCGCTGAAAGAGGTAGTTGAGGGTGGTGGCGGTGTGTTCTGCCACGAAGAAGTACATAACCCAGCGT
CGCAACGTGGATTCGTTGATATCCCCCAAGGCCTCAAGGCGCTCCATGGCCTCGTAGAAGTCCACGGCG
AAGTTGAAAAACTGGGAGTTGCGCGCCGACACGGTTAACTCCTCCTCCAGAAGACGGATGAGCTCGGCG
ACAGTGTCGCGCACCTCGCGCTCAAAGGCTACAGGGGCCTCTTCTTCTTCAATCTCCTCTTCCATA
AGGGCCTCCCCTTCTTCTTCTTCTGGCGGCGGTGGGGAGGGGGGACACGGCGGCGACGACGGCGCACC
GGGAGGCGGTCGACAAAGCGCTCGATCATCTCCCCGCGGCGACGGCGCATGGTCTCGGTGACGGCGCGG
CCGTTCTCGCGGGGGCGCAGTTGGAAGACGCCGCCCGTCATGTCCCGGTTATGGGTTGGCGGGGGGCTG
CCATGCGGCAGGGATACGGCGCTAACGATGCATCTCAACAATTGTTGTGTAGGTACTCCGCCGCCGAGG
GACCTGAGCGAGTCCGCATCGACCGGATCGGAAAACCTCTCGAGAAGGCGTCTAACCAGTCACAGTCG
CAAGGTAGGCTGAGCACCGTGGCGGCGGCAGCGGGCGGCGGTCGGGGTTGTTTCTGGCGGAGGTGCTG
CTGATGATGTAATTAAAGTAGGCGGTCTTGAGACGGCGGATGGTCGACAGAAGCACCATGTCCTTGGGT
CCGGCCTGCTGAATGCGCAGGCGGTCGGCCATGCCCCAGGCTTCGTTTTGACATCGGCGCAGGTCTTTG
TAGTAGTCTTGCATGAGCCTTTCTACCGGCACTTCTTCTTCTCCTTCCTCTTGTCCTGCATCTCTTGCA
TCTATCGCTGCGGCGGCGGCGGAGTTTGGCCGTAGGTGGCGCCCTCTTCCTCCCATGCGTGTGACCCCG
AAGCCCCTCATCGGCTGAAGCAGGGCTAGGTCGGCGACAACGCGCTCGGCTAATATGGCCTGCTGCACC
TGCGTGAGGGTAGACTGGAAGTCATCCATGTCCACAAAGCGGTGGTATGCGCCCGTGTTGATGGTGTAA
GTGCAGTTGGCCATAACGGACCAGTTAACGGTCTGGTGACCCGGCTGCGAGAGCTCGGTGTACCTGAGA
CGCGAGTAAGCCCTCGAGTCAAATACGTAGTCGTTGCAAGTCCGCACCAGGTACTGGTATCCCACCAAA
AAGTGCGGCGGCGGCTGGCGGTAGAGGGGCCAGCGTAGGGTGGCCGGGGCTCCGGGGCGAGATCTTCC
AACATAAGGCGATGATATCCGTAGATGTACCTGGACATCCAGGTGATGCCGGCGGCGGTGGTGGAGGCG
CGCGGAAAGTCGCGGACGCGGTTCCAGATGTTGCGCAGCGGCAAAAGTGCTCCATGGTCGGGACGCTC
TGGCCGGTCAGGCGCGCGCAATCGTTGACGCTCTAGACCGTGCAAAAGGAGAGCCTGTAAGCGGGCACT
CTTCCGTGGTCTGGTGGATAAATTCGCAAGGGTATCATGGCGGACGACCGGGGTTCGAGCCCCGTATCC
GGCCGTCCGCCGTGATCCATGCGGTTACCGCCCGCGTGTCGAACCCAGGTGTGCGACGTCAGACAACGG
GGGAGTGCTCCTTTTGGCTTCCTTCCAGGCGCGGCGGCTGCTGCGCTAGCTTTTTGGCCACTGGCCGC
GCGCAGCGTAAGCGGTTAGGCTGGAAAGCGAAAGCATTAAGTGGCTCGCTCCCTGTAGCCGGAGGGTTA
TTTTCAAGGGTTGAGTCGCGGGACCCCCGGTTCGAGTCTCGGACCGGCCGGACTGCGGCGAACGGGGG
TTTGCCTCCCCGTCATGCAAGACCCCGCTTGCAAATTCCTCCGGAAACAGGGACGAGCCCCTTTTTTGC
TTTTCCCAGATGCATCCGGTGCTGCGGCAGATGCGCCCCCTCCTCAGCAGCGGCAAGAGCAAGAGCAG
CGGCAGACATGCAGGGCACCCTCCCCTCCTCCTACCGCGTCAGGAGGGGCGACATCCGCGGTTGACGCG
GCAGCAGATGGTGATTACGAACCCCCGCGGCGCCGGGCCCGGCACTACCTGGACTTGGAGGAGGGCGAG
GGCCTGGCGCGGCTAGGAGCGCCCTCTCCTGAGCGGCACCCAAGGGTGCAGCTGAAGCGTGATACGCGT
GAGGCGTACGTGCCGCGGCAGAACCTGTTTCGCGACCGCGAGGGAGAGGAGCCCGAGGAGATGCGGGAT
CGAAAGTTCCACGCAGGGCGCGAGCTGCGGCATGGCCTGAATCGCGAGCGGTTGCTGCGCGAGGAGGAC
TTTGAGCCCGACGCGCGAACCGGGATTAGTCCCGCGCGCGCACACGTGGCGGCCGCCGACCTGGTAACC
GCATACGAGCAGACGGTGAACCAGGAGATTAACTTTCAAAAAGCTTTAACAACCACGTGCGTACGCTT
GTGGCGCGCGAGGAGGTGGCTATAGGACTGATGCATCTGTGGGACTTTGTAAGCGCGCTGGAGCAAAAC
CCAAATAGCAAGCCGCTCATGGCGCAGCTGTTCCTTATAGTGCAGCACAGCAGGGACAACGAGGCATTC
AGGGATGCGCTGCTAAACATAGTAGAGCCCGAGGGCCGCTGGCTGCTCGATTTGATAAACATCCTGCAG
AGCATAGTGGTGCAGGAGCGCAGCTTGAGCCTGGCTGACAAGGTGGCCGCCATCAACTATTCCATGCTT
AGCCTGGGCAAGTTTTACGCCCGCAAGATATACCATACCCCTTACGTTCCCATAGACAAGGAGGTAAAG
ATCGAGGGGTTCTACATGCGCATGGCGCTGAAGGTGCTTACCTTGAGCGACGACCTGGGCGTTTATCGC
```

Figure 72 continued

```
AACGAGCGCATCCACAAGGCCGTGAGCGTGAGCCGGCGGCGCGAGCTCAGCGACCGCGAGCTGATGCAC
AGCCTGCAAAGGGCCCTGGCTGGCACGGGCAGCGGCGATAGAGAGGCCGAGTCCTACTTTGACGCGGGC
GCTGACCTGCGCTGGGCCCCAAGCCGACGCGCCCTGGAGGCAGCTGGGGCCGGACCTGGGCTGGCGGTG
GCACCCGCGCGCGCTGGCAACGTCGGCGGCGTGGAGGAATATGACGAGGACGATGAGTACGAGCCAGAG
GACGGCGAGTACTAAGCGGTGATGTTTCTGATCAGATGATGCAAGACGCAACGGACCCGGCGGTGCGGG
CGGCGCTGCAGAGCCAGCCGTCCGGCCTTAACTCCACGGACGACTGGCGCCAGGTCATGGACCGCATCA
TGTCGCTGACTGCGCGCAATCCTGACGCGTTCCGGCAGCAGCCGCAGGCCAACCGGCTCTCCGCAATTC
TGGAAGCGGTGGTCCCGGCGCGCGCAAACCCCACGCACGAGAAGGTGCTGGCGATCGTAAACGCGCTGG
CCGAAAACAGGGCCATCCGGCCCGACGAGGCCGGCCTGGTCTACGACGCGCTGCTTCAGCGCGTGGCTC
GTTACAACAGCGGCAACGTGCAGACCAACCTGGACCGGCTGGTGGGGGATGTGCGCGAGGCCGTGGCGC
AGCGTGAGCGCGCGCAGCAGCAGGGCAACCTGGGCTCCATGGTTGCACTAAACGCCTTCCTGAGTACAC
AGCCCGCCAACGTGCCGCGGGGACAGGAGGACTACACCAACTTTGTGAGCGCACTGCGGCTAATGGTGA
CTGAGACACCGCAAAGTGAGGTGTACCAGTCTGGGCCAGACTATTTTTCCAGACCAGTAGACAAGGCC
TGCAGACCGTAAACCTGAGCCAGGCTTTCAAAAACTTGCAGGGGCTGTGGGGGGTGCGGGCTCCCACAG
GCGACCGCGCGACCGTGTCTAGCTTGCTGACGCCCAACTCGCGCCTGTTGCTGCTGCTAATAGCGCCCT
TCACGGACAGTGGCAGCGTGTCCCGGGACACATACCTAGGTCACTTGCTGACACTGTACCGCGAGGCCA
TAGGTCAGGCGCATGTGGACGAGCATACTTTCCAGGAGATTACAAGTGTCAGCCGCGCGCTGGGGCAGG
AGGACACGGGCAGCCTGGAGGCAACCCTAAACTACCTGCTGACCAACCGGCGGCAGAAGATCCCCTCGT
TGCACAGTTTAAACAGCGAGGAGGAGCGCATTTGCGCTACGTGCAGCAGAGCGTGAGCCTTAACCTGA
TGCGCGACGGGGTAACGCCCAGCGTGGCGCTGGACATGACCGCGCGCAACATGGAACCGGGCATGTATG
CCTCAAACCGGCCGTTTATCAACCGCCTAATGGACTACTTGCATCGCGCGGCCGCCGTGAACCCCGAGT
ATTTCACCAATGCCATCTTGAACCCGCACTGGCTACCGCCCCCTGGTTTCTACACCGGGGGATTCGAGG
TGCCCGAGGGTAACGATGGATTCCTCTGGGACGACATAGACGACAGCGTGTTTTCCCCGCAACCGCAGA
CCCTGCTAGAGTTGCAACAGCGCGAGCAGGCAGAGGCGGCGCTGCGAAAGGAAAGCTTCCGCAGGCCAA
GCAGCTTGTCCGATCTAGGCGCTGCGGCCCCGCGGTCAGATGCTAGTAGCCCATTTCCAAGCTTGATAG
GGTCTCTTACCAGCACTCGCACCACCCGCCCGCGCCTGCTGGGCGAGGAGGAGTACCTAAACAACTCGC
TGCTGCAGCCGCAGCGCGAAAAAAACCTGCCTCCGGCATTTCCCAACAACGGGATAGAGAGCCTAGTGG
ACAAGATGAGTAGATGGAAGACGTACGCGCAGGAGCACAGGGACGTGCCAGGCCCGCGCCCGCCCACCC
GTCGTCAAAGGCACGACCGTCAGCGGGGTCTGGTGTGGGAGGACGATGACTCGGCAGACGACAGCAGCG
TCCTGGATTTGGGAGGGAGTGGCAACCCGTTTGCGCACCTTCGCCCCAGGCTGGGGAGAATGTTTTAAA
AAAAAAAAAGCATGATGCAAAATAAAAAACTCACCAAGGCCATGGCACCGAGCGTTGGTTTTCTTGTAT
TCCCCTTAGTATGCGGCGCGCGGCGATGTATGAGGAAGGTCCTCCTCCCTCCTACGAGAGTGTGGTGAG
CGCGGCGCCAGTGGCGGCGGCGCTGGGTTCTCCCTTCGATGCTCCCCTGGACCCGCCGTTTGTGCCTCC
GCGGTACCTGCGGCCTACCGGGGGAGAAACAGCATCCGTTACTCTGAGTTGGCACCCCTATTCGACAC
CACCCGTGTGTACCTGGTGGACAACAAGTCAACGGATGTGGCATCCCTGAACTACCAGAACGACCACAG
CAACTTTCTGACCACGGTCATTCAAAACAATGACTACAGCCCGGGGGAGGCAAGCACACAGACCATCAA
TCTTGACGACCGGTCGCACTGGGGCGGCGACCTGAAAACCATCCTGCATACCAACATGCCAAATGTGAA
CGAGTTCATGTTTACCAATAAGTTTAAGGCGCGGGTGATGGTGTCGCGCTTGCCTACTAAGGACAATCA
GGTGGAGCTGAAATACGAGTGGGTGGAGTTCACGCTGCCCGAGGGCAACTACTCCGAGACCATGACCAT
AGACCTTATGAACAACGCGATCGTGGAGCACTACTTGAAAGTGGGCAGACAGAACGGGGTTCTGGAAAG
CGACATCGGGGTAAAGTTTGACACCCGCAACTTCAGACTGGGGTTTGACCCCGTCACTGGTCTTGTCAT
GCCTGGGGTATATACAAACGAAGCCTTCCATCCAGACATCATTTTGCTGCCAGGATGCGGGGTGGACTT
CACCCACAGCCGCCTGAGCAACTTGTTGGGCATCCGCAAGCGGCAACCCTTCCAGGAGGGCTTTAGGAT
CACCTACGATGATCTGGAGGGTGGTAACATTCCCGCACTGTTGGATGTGGACGCCTACCAGGCGAGCTT
GAAAGATGACACCGAACAGGGCGGGGGTGGCGCAGGCGGCAGCAACAGCAGTGGCAGCGGCGCGGAAGA
GAACTCCAACGCGGCAGCCGCGGCAATGCAGCCGGTGGAGGACATGAACGATCATGCCATTCGCGGCGA
CACCTTTGCCACACGGGCTGAGGAGAAGCGCGCTGAGGCCGAAGCAGCGGCCGAAGCTGCCGCCCCCGC
TGCGCAACCCGAGGTCGAGAAGCCTCAGAAGAAACCGGTGATCAAACCCCTGACAGAGGACAGCAAGAA
ACGCAGTTACAACCTAATAAGCAATGACAGCACCTTCACCCAGTACCGCAGCTGGTACCTTGCATACAA
CTACGGCGACCCTCAGACCGGAATCCGCTCATGGACCCTGCTTTGCACTCCTGACGTAACCTGCGGCTC
GGAGCAGGTCTACTGGTCGTTGCCAGACATGATGCAAGACCCCGTGACCTTCCGCTCCACGCGCCAGAT
CAGCAACTTTCCGGTGGTGGGCGCCGAGCTGTTGCCCGTGCACTCCAAGAGCTTCTACAACGACCAGGC
```

Figure 72 continued

```
CGTCTACTCCCAACTCATCCGCCAGTTTACCTCTCTGACCCACGTGTTCAATCGCTTTCCCGAGAACCA
GATTTTGGCGCGCCCGCCAGCCCCCACCATCACCACCGTCAGTGAAAACGTTCCTGCTCTCACAGATCA
CGGGACGCTACCGCTGCGCAACAGCATCGGAGGAGTCCAGCGAGTGACCATTACTGACGCCAGACGCCG
CACCTGCCCCTACGTTTACAAGGCCCTGGGCATAGTCTCGCCGCGCGTCCTATCGAGCCGCACTTTTTG
AGCAAGCATGTCCATCCTTATATCGCCCAGCAATAACACAGGCTGGGGCCTGCGCTTCCCAAGCAAGAT
GTTTGGCGGGGCCAAGAAGCGCTCCGACCAACACCCAGTGCGCGTGCGCGGGCACTACCGCGCGCCCTG
GGGCGCGCACAAACGCGGCCGCACTGGGCGCACCACCGTCGATGACGCCATCGACGCGGTGGTGGAGGA
GGCGCGCAACTACACGCCCACGCCGCCACCAGTGTCCACAGTGGACGCGGCCATTCAGACCGTGGTGCG
CGGAGCCCGGCGCTATGCTAAAATGAAGAGACGGCGGAGGCGCGTAGCACGTCGCCACCGCCGCCGACC
CGGCACTGCCGCCCAACGCGCGGCGGCGGCCCTGCTTAACCGCGCACGTCGCACCGGCCGACGGGCGGC
CATGCGGGCCGCTCGAAGGCTGGCCGCGGGTATTGTCACTGTGCCCCCAGGTCCAGGCGACGAGCGGC
CGCCGCAGCAGCCGCGGCCATTAGTGCTATGACTCAGGGTCGCAGGGGCAACGTGTATTGGGTGCGCGA
CTCGGTTAGCGGCCTGCGCGTGCCCGTGCGCACCCGCCCCCGCGCAACTAGATTGCAAGAAAAAACTA
CTTAGACTCGTACTGTTGTATGTATCCAGCGGCGGCGGCGCGCAACGAAGCTATGTCCAAGCGCAAAAT
CAAAGAAGAGATGCTCCAGGTCATCGCGCCGGAGATCTATGGCCCCCGAAGAAGGAAGAGCAGGATTA
CAAGCCCCGAAAGCTAAAGCGGGTCAAAAAGAAAAAGAAAGATGATGATGATGAACTTGACGACGAGGT
GGAACTGCTGCACGCTACCGCGCCCAGGCGACGGGTACAGTGGAAAGGTCGACGCGTAAAACGTGTTTT
GCGACCCGGCACCACCGTAGTCTTTACGCCCGGTGAGCGCTCCACCCGCACCTACAAGCGCGTGTATGA
TGAGGTGTACGGCGACGAGGACCTGCTTGAGCAGGCCAACGAGCGCCTCGGGGAGTTTGCCTACGGAAA
GCGGCATAAGGACATGCTGGCGTTGCCGCTGGACGAGGGCAACCCAACACCTAGCCTAAAGCCCGTAAC
ACTGCAGCAGGTGCTGCCCGCGCTTGCACCGTCCGAAGAAAAGCGCGGCCTAAAGCGCGAGTCTGGTGA
CTTGGCACCCACCGTGCAGCTGATGGTACCCAAGCGCCAGCGACTGGAAGATGTCTTGGAAAAAATGAC
CGTGGAACCTGGGCTGGAGCCCGAGGTCCGCGTGCGGCCAATCAAGCAGGTGGCGCCGGGACTGGGCGT
GCAGACCGTGGACGTTCAGATACCCACTACCAGTAGCACCAGTATTGCCACCGCCACAGAGGGCATGGA
GACACAAACGTCCCCGGTTGCCTCAGCGGTGGCGGATGCCGCGGTGCAGGCGGTCGCTGCGGCCGCGTC
CAAGACCTCTACGGAGGTGCAAACGGACCCGTGGATGTTTCGCGTTTCAGCCCCCGGCGCCCGCGCCG
TTCGAGGAAGTACGGCGCCGCCAGCGCGCTACTGCCCGAATATGCCCTACATCCTTCCATTGCGCCTAC
CCCCGGCTATCGTGGCTACACCTACCGCCCCAGAAGACGAGCAACTACCCGACGCCGAACCACCACTGG
AACCCGCCGCCGCCGTCGCCGTCGCCAGCCCGTGCTGGCCCCGATTTCCGTGCGCAGGGTGGCTCGCGA
AGGAGGCAGGACCCTGGTGCTGCCAACAGCGCGCTACCACCCCAGCATCGTTTAAAAGCCGGTCTTTGT
GGTTCTTGCAGATATGGCCCTCACCTGCCGCCTCCGTTTCCCGGTGCCGGGATTCCGAGGAAGAATGCA
CCGTAGGAGGGCATGGCCGGCCACGGCCTGACGGGCGGCATGCGTCGTGCGCACCACCGGCGGCGGCG
CGCGTCGCACCGTCGCATGCGCGGCGGTATCCTGCCCCTCCTTATTCCACTGATCGCCGCGGCGATTGG
CGCCGTGCCCGGAATTGCATCCGTGGCCTTGCAGGCGCAGAGACACTGATTAAAAACAAGTTGCATGTG
GAAAAATCAAAATAAAAAGTCTGGACTCTCACGCTCGCTTGGTCCTGTAACTATTTTGTAGAATGGAAG
ACATCAACTTTGCGTCTCTGGCCCCGCGACACGGCTCGCGCCCGTTCATGGGAAACTGGCAAGATATCG
GCACCAGCAATATGAGCGGTGGCGCCTTCAGCTGGGGCTCGCTGTGGAGCGGCATTAAAAATTTCGGTT
CCACCGTTAAGAACTATGGCAGCAAGGCCTGGAACAGCAGCACAGGCCAGATGCTGAGGGATAAGTTGA
AAGAGCAAAATTTCCAACAAAGGTGGTAGATGGCCTGGCCTCTGGCATTAGCGGGTGGTGGACCTGG
CCAACCAGGCAGTGCAAAATAAGATTAACAGTAAGCTTGATCCCCGCCCTCCCGTAGAGGAGCCTCCAC
CGGCCGTGGAGACAGTGTCTCCAGAGGGGCGTGGCGAAAAGCGTCCGCGCCCCGACAGGGAAGAAACTC
TGGTGACGCAAATAGACGAGCCTCCCTCGTACGAGGAGGCACTAAAGCAAGGCCTGCCCACCACCCGTC
CCATCGCGCCCATGGCTACCGGAGTGCTGGGCCAGCACACACCCGTAACGCTGGACCTGCCTCCCCCCG
CCGACACCCAGCAGAAACCTGTGCTGCCAGGCCCGACCGCCGTTGTTGTAACCCGTCCTAGCCGCGCGT
CCCTGCGCCGCGCCGCCAGCGGTCCGCGATCGTTGCGGCCCGTAGCCAGTGGCAACTGGCAAAGCACAC
TGAACAGCATCGTGGGTCTGGGGGTGCAATCCCTGAAGCGCCGACGATGCTTCTGATAGCTAACGTGTC
GTATGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAG
TACCTGAGCCCCGGGCTGGTGCAGTTTGCCCGCGCCACCGAGACGTACTTCAGCCTGAATAACAAGTTT
AGAAACCCCACGGTGGCGCCTACGCACGACGTGACCACAGACCGGTCCCAGCGTTTGACGCTGCGGTTC
ATCCCTGTGGACCGTGAGGATACTGCGTACTCGTACAAGGCGCGGTTCACCCTAGCTGTGGGTGATAAC
CGTGTGCTGGACATGGCTTCCACGTACTTTGACATCCGCGGCGTGCTGGACAGGGGCCCTACTTTTAAG
```

Figure 72 continued

```
CCCTACTCTGGCACTGCCTACAACGCCCTGGCTCCCAAGGGTGCCCCAAATCCTTGCGAATGGGATGAA
GCTGCTACTGCTCTTGAAATAAACCTAGAAGAAGAGGACGATGACAACGAAGACGAAGTAGACGAGCAA
GCTGAGCAGCAAAAAACTCACGTATTTGGGCAGGCGCCTTATTCTGGTATAAATATTACAAAGGAGGGT
ATTCAAATAGGTGTCGAAGGTCAAACACCTAAATATGCCGATAAAACATTTCAACCTGAACCTCAAATA
GGAGAATCTCAGTGGTACGAAACAGAAATTAATCATGCAGCTGGGAGAGTCCTAAAAAGACTACCCCA
ATGAAACCATGTTACGGTTCATATGCAAAACCCACAAATGAAAATGGAGGGCAAGGCATTCTTGTAAAG
CAACAAAATGGAAAGCTAGAAAGTCAAGTGGAAATGCAATTTTCTCAACTACTGAGGCAGCCGCAGGC
AATGGTGATAACTTGACTCCTAAAGTGGTATTGTACAGTGAAGATGTAGATATAGAAACCCCAGACACT
CATATTTCTTACATGCCCACTATTAAGGAAGGTAACTCACGAGAACTAATGGGCCAACAATCTATGCCC
AACAGGCCTAATTACATTGCTTTTAGGGACAATTTTATTGGTCTAATGTATTACAACAGCACGGGTAAT
ATGGGTGTTCTGGCGGGCCAAGCATCGCAGTTGAATGCTGTTGTAGATTTGCAAGACAGAAACACAGAG
CTTTCATACCAGCTTTTGCTTGATTCCATTGGTGATAGAACCAGGTACTTTTCTATGTGGAATCAGGCT
GTTGACAGCTATGATCCAGATGTTAGAATTATTGAAATCATGGAACTGAAGATGAACTTCCAAATTAC
TGCTTTCCACTGGGAGGTGTGATTAATACAGAGACTCTTACCAAGGTAAAACCTAAAACAGGTCAGGAA
AATGGATGGGAAAAGATGCTACAGAATTTTCAGATAAAAATGAAATAAGAGTTGGAAATAATTTTGCC
ATGGAAATCAATCTAAATGCCAACCTGTGGAGAAATTTCCTGTACTCCAACATAGCGCTGTATTTGCCC
GACAAGCTAAAGTACAGTCCTTCCAACGTAAAAATTTCTGATAACCCAAACACCTACGACTACATGAAC
AAGCGAGTGGTGGCTCCCGGGCTAGTGGACTGCTACATTAACCTTGGAGCACGCTGGTCCCTTGACTAT
ATGGACAACGTCAACCCATTTAACCACCACCGCAATGCTGGCCTGCGCTACCGCTCAATGTTGCTGGGC
AATGGTCGCTATGTGCCCTTCCACATCCAGGTGCCTCAGAAGTTCTTTGCCATTAAAAACCTCCTTCTC
CTGCCGGGCTCATACACCTACGAGTGGAACTTCAGGAAGGATGTTAACATGGTTCTGCAGAGCTCCCTA
GGAAATGACCTAAGGGTTGACGGAGCCAGCATTAAGTTTGATAGCATTTGCCTTTACGCCACCTTCTTC
CCCATGGCCCACAACACCGCCTCCACGCTTGAGGCCATGCTTAGAAACGACACCAACGACCAGTCCTTT
AACGACTATCTCTCCGCCGCCAACATGCTCTACCCTATACCCGCCAACGCTACCAACGTGCCCATATCC
ATCCCTCCCGCAACTGGGCGGCTTTCCGCGGCTGGGCCTTCACGCGCCTTAAGACTAAGGAAACCCCA
TCACTGGGCTCGGGCTACGACCCTTATTACACCTACTCTGGCTCTATACCCTACCTAGATGGAACCTTT
TACCTCAACCACACCTTTAAGAAGGTGGCCATTACCTTTGACTCTTCTGTCAGCTGGCCTGGCAATGAC
CGCCTGCTTACCCCCAACGAGTTTGAAATTAAGCGCTCAGTTGACGGGGAGGGTTACAACGTTGCCCAG
TGTAACATGACCAAAGACTGGTTCCTGGTACAAATGCTAGCTAACTATAACATTGGCTACCAGGGCTTC
TATATCCCAGAGAGCTACAAGGACCGCATGTACTCCTTCTTTAGAAACTTCCAGCCCATGAGCCGTCAG
GTGGTGGATGATACTAAATACAAGGACTACCAACAGGTGGGCATCCTACACCAACACAACAACTCTGGA
TTTGTTGGCTACCTTGCCCCCACCATGCGCGAAGGACAGGCCTACCCTGCTAACTTCCCCTATCCGCTT
ATAGGCAAGACCGCAGTTGACAGCATTACCCAGAAAAAGTTTCTTTGCGACCGCACCCTTTGGCGCATC
CCATTCTCCAGTAACTTTATGTCCATGGGCGCACTCACAGACCTGGGCCAAAACCTTCTCTACGCCAAC
TCCGCCCACGCGCTAGACATGACTTTTGAGGTGGATCCCATGGACGAGCCCACCCTTCTTTATGTTTTG
TTTGAAGTCTTTGACGTGGTCCGTGTGCACCAGCCGCACCGCGGCGTCATCGAAACCGTGTACCTGCGC
ACGCCCTTCTCGGCCGGCAACGCCACAACATAAAGAAGCAAGCAACATCAACAACAGCTGCCGCCATGG
GCTCCAGTGAGCAGGAACTGAAAGCCATTGTCAAAGATCTTGGTTGTGGGCCATATTTTTGGGCACCT
ATGACAAGCGCTTTCCAGGCTTTGTTTCTCCACACAAGCTCGCCTGCGCCATAGTCAATACGGCCGGTC
GCGAGACTGGGGCGTACACTGGATGGCCTTTGCCTGGAACCCGCACTCAAAACATGCTACCTCTTTG
AGCCCTTTGGCTTTTCTGACCAGCGACTCAAGCAGGTTACCAGTTTGAGTACGAGTCACTCCTGCGCC
GTAGCGCCATTGCTTCTTCCCCGACCGCTGTATAACGCTGGAAAAGTCCACCCAAAGCGTACAGGGGC
CCAACTCGGCCGCCTGTGGACTATTCTGCTGCATGTTTCTCCACGCCTTTGCCAACTGGCCCCAAACTC
CCATGGATCACAACCCCACCATGAACCTTATTACCGGGGTACCCAACTCCATGCTCAACAGTCCCCAGG
TACAGCCCACCCTGCGTCGCAACCAGGAACAGCTCTACAGCTTCCTGGAGCGCCACTCGCCCTACTTCC
GCAGCCACAGTGCGCAGATTAGGAGCGCCACTTCTTTTGTCACTTGAAAAACATGTAAAAATAATGTA
CTAGAGACACTTTCAATAAAGGCAAATGCTTTTATTTGTACACTCTCGGGTGATTATTTACCCCCACCC
TTGCCGTCTGCGCCGTTTAAAAATCAAAGGGGTTCTGCCGCGCATCGCTATGCGCCACTGGCAGGGACA
CGTTGCGATACTGGTGTTTAGTGCTCCACTTAAACTCAGGCACAACCATCCGCGGCAGCTCGGTGAAGT
TTTCACTCCACAGGCTGCGCACCATCACCAACGCGTTTAGCAGGTCGGGCGCCGATATCTTGAAGTCGC
AGTTGGGGCCTCCGCCCTGCGCGCGCGAGTTGCGATACACAGGGTTGCAGCACTGGAACACTATCAGCG
CCGGGTGGTGCACGCTGGCCAGCACGCTCTTGTCGGAGATCAGATCCGCGTCCAGGTCCTCCGCGTTGC
```

Figure 72 continued

```
TCAGGGCGAACGGAGTCAACTTTGGTAGCTGCCTTCCCAAAAAGGGCGCGTGCCCAGGCTTTGAGTTGC
ACTCGCACCGTAGTGGCATCAAAAGGTGACCGTGCCCGGTCTGGGCGTTAGGATACAGCGCCTGCATAA
AAGCCTTGATCTGCTTAAAAGCCACCTGAGCCTTTGCGCCTTCAGAGAAGAACATGCCGCAAGACTTGC
CGGAAAACTGATTGGCCGGACAGGCCGCGTCGTGCACGCAGCACCTTGCGTCGGTGTTGGAGATCTGCA
CCACATTTCGGCCCCACCGGTTCTTCACGATCTTGGCCTTGCTAGACTGCTCCTTCAGCGCGCGCTGCC
CGTTTTCGCTCGTCACATCCATTTCAATCACGTGCTCCTTATTTATCATAATGCTTCCGTGTAGACACT
TAAGCTCGCCTTCGATCTCAGCGCAGCGGTGCAGCCACAACGCGCAGCCCGTGGGCTCGTGATGCTTGT
AGGTCACCTCTGCAAACGACTGCAGGTACGCCTGCAGGAATCGCCCCATCATCGTCACAAAGGTCTTGT
TGCTGGTGAAGGTCAGCTGCAACCCGCGGTGCTCCTCGTTCAGCCAGGTCTTGCATACGGCCGCCAGAG
CTTCCACTTGGTCAGGCAGTAGTTTGAAGTTCGCCTTTAGATCGTTATCCACGTGGTACTTGTCCATCA
GCGCGCGCGCAGCCTCCATGCCCTTCTCCCACGCAGACACGATCGGCACACTCAGCGGGTTCATCACCG
TAATTTCACTTTCCGCTTCGCTGGGCTCTTCCTCTTCCTCTTGCGTCCGCATACCACGCGCCACTGGGT
CGTCTTCATTCAGCCGCCGCACTGTGCGCTTACCTCCTTTGCCATGCTTGATTAGCACCGGTGGGTTGC
TGAAACCCACCATTTGTAGCGCCACATCTTCTCTTTCTTCCTCGCTGTCCACGATTACCTCTGGTGATG
GCGGGCGCTCGGGCTTGGGAGAAGGGCGCTTCTTTTTCTTCTTGGGCGCAATGGCCAAATCCGCCGCCG
AGGTCGATGGCCGCGGGCTGGGTGTGCGCGGCACCAGCGCGTCTTGTGATGAGTCTTCCTCGTCCTCGG
ACTCGATACGCCGCCTCATCCGCTTTTTGGGGGCGCCCGGGGAGGCGGCGGCGACGGGGACGGGGACG
ACACGTCCTCCATGGTTGGGGACGTCGCGCCGCACCGCGTCCGCGCTCGGGGGTGGTTTCGCGCTGCT
CCTCTTCCCGACTGGCCATTTCCTTCTCCTATAGGCAGAAAAAGATCATGGAGTCAGTCGAGAAGAAGG
ACAGCCTAACCGCCCCCTCTGAGTTCGCCACCACCGCCTCCACCGATGCCGCCAACGCGCCTACCACCT
TCCCCGTCGAGGCACCCCCGCTTGAGGAGGAGGAAGTGATTATCGAGCAGGACCCAGGTTTTGTAAGCG
AAGACGACGAGGACCGCTCAGTACCAACAGAGGATAAAAAGCAAGACCAGGACAACGCAGAGGCAAACG
AGGAACAAGTCGGGCGGGGGACGAAAGGCATGGCGACTACCTAGATGTGGGAGACGACGTGCTGTTGA
AGCATCTGCAGCGCCAGTGCGCCATTATCTGCGACGCGTTGCAAGAGCGCAGCGATGTGCCCCTCGCCA
TAGCGGATGTCAGCCTTGCCTACGAACGCCACCTATTCTCACCGCGCGTACCCCCAAACGCCAAGAAA
ACGGCACATGCGAGCCCAACCCGCGCCTCAACTTCTACCCCGTATTTGCCGTGCCAGAGGTGCTTGCCA
CCTATCACATCTTTTTCCAAAACTGCAAGATACCCCTATCCTGCCGTGCCAACCGCAGCCGAGCGGACA
AGCAGCTGGCCTTGCGGCAGGGCGCTGTCATACCTGATATCGCCTCGCTCAACGAAGTGCCAAAAATCT
TTGAGGGTCTTGGACGCGACGAGAAGCGCGCGGCAAACGCTCTGCAACAGGAAAACAGCGAAAATGAAA
GTCACTCTGGAGTGTTGGTGGAACTCGAGGGTGACAACGCGCGCCTAGCCGTACTAAAACGCAGCATCG
AGGTCACCCACTTTGCCTACCCGGCACTTAACCTACCCCCCAAGGTCATGAGCACAGTCATGAGTGAGC
TGATCGTGCGCCGTGCGCAGCCCCTGGAGAGGGATGCAAATTTGCAAGAACAAACAGAGGAGGGCCTAC
CCGCAGTTGGCGACGAGCAGCTAGCGCGCTGGCTTCAAACGCGCGAGCCTGCCGACTTGGAGGAGCGAC
GCAAACTAATGATGGCCGCAGTGCTCGTTACCGTGGAGCTTGAGTGCATGCAGCGGTTCTTTGCTGACC
CGGAGATGCAGCGCAAGCTAGAGGAAACATTGCACTACACCTTTCGACAGGGCTACGTACGCCAGGCCT
GCAAGATCTCCAACGTGGAGCTCTGCAACCTGGTCTCCTACCTTGGAATTTTGCACGAAAACCGCCTTG
GGCAAAACGTGCTTCATTCCACGCTCAAGGGCGAGGCGCGCCGCGACTACGTCCGCGACTGCGTTTACT
TATTTCTATGCTACACCTGGCAGACGGCCATGGGCGTTTGGCAGCAGTGCTTGGAGGAGTGCAACCTCA
AGGAGCTGCAGAAACTGCTAAAGCAAAACTTGAAGGACCTATGGACGGCCTTCAACGAGCGCTCCGTGG
CCGCGCACCTGGCGGACATCATTTTCCCCGAACGCCTGCTTAAAACCCTGCAACAGGGTCTGCCAGACT
TCACCAGTCAAAGCATGTTGCAGAACTTTAGGAACTTTATCCTAGAGCGCTCAGGAATCTTGCCCGCCA
CCTGCTGTGCACTTCCTAGCGACTTTGTGCCCATTAAGTACCGCGAATGCCCTCCGCCGCTTTGGGCC
ACTGCTACCTTCTGCAGCTAGCCAACTACCTTGCCTACCACTCTGACATAATGGAAGACGTGAGCGGTG
ACGGTCTACTGGAGTGTCACTGTCGCTGCAACCTATGCACCCCGCACCGCTCCCTGGTTTGCAATTCGC
AGCTGCTTAACGAAAGTCAAATTATCGGTACCTTTGAGCTGCAGGGTCCCTCGCCTGACGAAAAGTCCG
CGGCTCCGGGGTTGAAACTCACTCCGGGGCTGTGGACGTCGGCTTACCTTCGCAAATTTGTACCTGAGG
ACTACCACGCCCACGAGATTAGGTTCTACGAAGACCAATCCCGCCCGCCTAATGCGGAGCTTACCGCCT
GCGTCATTACCCAGGGCCACATTCTTGGCCAATTGCAAGCCATCAACAAAGCCCGCCAAGAGTTTCTGC
TACGAAAGGGACGGGGGGTTTACTTGGACCCCCAGTCCGGCGAGGAGCTCAACCCAATCCCCCCGCCGC
CGCAGCCCTATCAGCAGCCGCGGGCCCTTGCTTCCCAGGATGGCACCCAAAAAGAAGCTGCAGCTG
CCGCCGCCACCCACGGACGAGGAGGAATACTGGGACAGTCAGGCAGAGGAGGTTTTGGACGAGGAGGAG
GAGGACATGATGGAAGACTGGGAGAGCCTAGACGAGGAAGCTTCCGAGGTCGAAGAGGTGTCAGACGAA
```

Figure 72 continued

```
ACACCGTCACCCTCGGTCGCATTCCCCTCGCCGGCGCCCCAGAAATCGGCAACCGGTTCCAGCATGGCT
ACAACCTCCGCTCCTCAGGCGCCGCCGGCACTGCCCGTTCGCCGACCCAACCGTAGATGGGACACCACT
GGAACCAGGGCCGGTAAGTCCAAGCAGCCGCCGCCGTTAGCCCAAGAGCAACAACAGCGCCAAGGCTAC
CGCTCATGGCGCGGGCACAAGAACGCCATAGTTGCTTGCTTGCAAGACTGTGGGGGCAACATCTCCTTC
GCCCGCCGCTTTCTTCTCTACCATCACGGCGTGGCCTTCCCCGTAACATCCTGCATTACTACCGTCAT
CTCTACAGCCCATACTGCACCGGCGGCAGCGGCAGCAACAGCAGCGGCCACACAGAAGCAAAGGCGACC
GGATAGCAAGACTCTGACAAAGCCCAAGAAATCCACAGCGGCGGCAGCAGCAGGAGGAGGAGCGCTGCG
TCTGGCGCCCAACGAACCCGTATCGACCCGCGAGCTTAGAAACAGGATTTTTCCCACTCTGTATGCTAT
ATTTCAACAGAGCAGGGGCCAAGAACAAGAGCTGAAAATAAAAAACAGGTCTCTGCGATCCCTCACCCG
CAGCTGCCTGTATCACAAAAGCGAAGATCAGCTTCGGCGCACGCTGGAAGACGCGGAGGCTCTCTTCAG
TAAATACTGCGCGCTGACTCTTAAGGACTAGTTTCGCGCCCTTTCTCAAATTTAAGCGCGAAAACTACG
TCATCTCCAGCGGCCACACCCGGCGCCAGCACCTGTTGTCAGCGCCATTATGAGCAAGGAAATTCCCAC
GCCCTACATGTGGAGTTACCAGCCACAAATGGGACTTGCGGCTGGAGCTGCCCAAGACTACTCAACCCG
AATAAACTACATGAGCGCGGGACCCCACATGATATCCCGGGTCAACGGAATACGCGCCCACCGAAACCG
AATTCCCTTGGAACAGGCGGCTATTACCACCACACCTCGTAATAACCTTAATCCCCGTAGTTGGCCCGC
TGCCCTGGTGTACCAGGAAAGTCCCGCTCCCACCACTGTGGTACTTCCCAGAGACGCCCAGGCCGAAGT
TCAGATGACTAACTCAGGGGCGCAGCTTGCGGGCGGCTTTCGTCACAGGGTGCGGTCGCCCGGGCAGGG
TATAACTCACCTGACAATCAGAGGGCGAGGTATTCAGCTCAACGACGAGTCGGTGAGCTCCTCGCTTGG
TCTCCGTCCGGACGGGACATTTCAGATCGGCGGCGCCGGCCGCTCTTCATTCACGCCTCGTCAGGCAAT
CCTAACTCTGCAGACCTCGTCCTCTGAGCCGCGCTCTGGAGGCATTGGAACTCTGCAATTTATTGAGGA
GTTTGTGCCATCGGTCTACTTTAACCCCTTCTCGGGACCTCCCGGCCACTATCCGGATCAATTTATTCC
TAACTTTGACGCGGTAAAGGACTCGGCGGACGGCTACGACTGAATGTTAAGTGGAGAGGCAGAGCAACT
GCGCCTGAAACACCTGGTCCACTGTCGCCGCCACAAGTGCTTTGCCCGCGACTCCGGTGAGTTTTGCTA
CTTTGAATTGCCCGAGGATCATATCGAGGGCCCGGCGCACGGCGTCCGGCTTACCGCCCAGGGAGAGCT
TGCCCGTAGCCTGATTCGGGAGTTTACCCAGCGCCCCTGCTAGTTGAGCGGGACAGGGGACCCTGTGT
TCTCACTGTGATTTGCAACTGTCCTAACCTTGGATTACATCAAGATCATCTTATTCCCTTTAACTAATA
AAAAAAAATAATAAAGCATCACTTACTTAAAATCAGTTAGCAAATTTATGCATGTCGACAGTAATCAAT
TACGGGGTCATTAGTTCATAGCCCATATATGGAGTTCCGCGTTACATAACTTACGGTAAATGGCCCGCC
TGGCTGACCGCCCAACGACCCCCGCCCATTGACGTCAATAATGACGTATGTTCCCATAGTAACGCCAAT
AGGGACTTTCCATTGACGTCAATGGGTGGAGTATTTACGGTAAACTGCCCACTTGGCAGTACATCAAGT
GTATCATATGCCAAGTACGCCCCCTATTGACGTCAATGACGGTAAATGGCCCGCCTGGCATTATGCCCA
GTACATGACCTTATGGGACTTTCCTACTTGGCAGTACATCTACGTATTAGTCATCGCTATTACCATGCT
GATGCGGTTTTGGCAGTACATCAATGGGCGTGGATAGCGGTTTGACTCACGGGGATTTCCAAGTCTCCA
CCCCATTGACGTCAATGGGAGTTTGTTTTGGCACCAAAATCAACGGGACTTTCCAAAATGTCGTAACAA
CTCCGCCCCATTGACGCAAATGGGCGGTAGGCGTGTACGGTGGGAGGTCTATATAAGCAGAGCTGGTTT
AGTGAACCGTCAGATCAGATCTTTGTCGATCCTACCATCCACTCGACACACCCGCCAGCGGCCGCTGCC
AAGCTTCCGAGCTCTCGAATTCAAAGGAGGTACCCACCATGGGATGGAGCTGTATCATCCTCTTCTTGG
TAGCAACAGCTACAGGTGTCCACTCCCAGGTGCAGCTGCAGCAGTCTGGGGCTGAACTGGCAAGACCTG
GGGCCTCAGTGAAGATGTCCTGCAAGGCTTCTGGCTACACCTTTACTAGGTACACGATGCACTGGGTAA
AACAGAGGCCTGGACAGGGTCTGGAATGGATTGGATACATTAATCCTAGCCGTGGTTATACTAATTACA
ATCAGAAGTTCAAGGACAAGGCCACATTGACTACAGACAAATCCTCCAGCACAGCCTACATGCAACTGA
GCAGCCTGACATCTGAGGACTCTGCAGTCTATTACTGTGCAAGATATTATGATGATCATTACTGCCTTG
ACTACTGGGGCCAAGGCACCACTCTCACAGTCTCCTCAGGTGGCGGTGGCTCGGGCGGTGGTGGATCTG
GTGGCGGCGGATCTGATATCGTGCTCACTCAGTCTCCAGCAATCATGTCTGCATCTCCAGGGGAGAAGG
TCACCATGACCTGCAGTGCCAGCTCAAGTGTAAGTTACATGAACTGGTACCAGCAGAAGTCAGGCACCT
CCCCCAAAAGATGGATTTATGACACATCCAAACTGGCTTCTGGAGTCCCTGCTCACTTCAGGGGCAGTG
GGTCTGGGACCTCTTACTCTCTCACAATCAGCGGCATGGAGGCTGAAGATGCTGCCACTTATTACTGCC
AGCAGTGGAGTAGTAACCCATTCACGTTCGGCTCGGGGACAAAGTTGGAAATAAACCGGGGATCCGAAC
AAAAACTCATCTCAGAAGAGGATCTGAATGCTGTGGGCCAGGACACGCAGGAGGTCATCGTGGTGCCAC
ACTCCTTGCCCTTTAAGGTGGTGGTGATCTCAGCCATCCTGGCCCTGGTGGTGCTCACCATCATCTCCC
TTATCATCCTCATCATGCTTTGGCAGAAGAAGCCACGTGGAAGCGGAGCTACTAACTTCAGCCTGCTGA
AGCAGGCTGGAGACGTGGAGGAGAACCCTGGACCTGGCCACACACGGAGGCAGGGAACATCACCATCCA
```

Figure 72 continued

```
AGTGTCCATACCTCAATTTCTTTCAGCTCTTGGTGCTGGCTGGTCTTTCTCACTTCTGTTCAGGTGTTA
TCCACGTGACCAAGGAAGTGAAAGAAGTGGCAACGCTGTCCTGTGGTCACAATGTTTCTGTTGAAGAGC
TGGCACAAACTCGCATCTACTGGCAAAAGGAGAAGAAATGGTGCTGACTATGATGTCTGGGGACATGA
ATATATGGCCCGAGTACAAGAACCGGACCATCTTTGATATCACTAATAACCTCTCCATTGTGATCCTGG
CTCTGCGCCCATCTGACGAGGGCACATACGAGTGTGTTGTTCTGAAGTATGAAAAGACGCTTTCAAGC
GGGAACACCTGGCTGAAGTGACGTTATCAGTCAAAGCTGACTTCCCTACACCTAGTATATCTGACTTTG
AAATTCCAACTTCTAATATTAGAAGGATAATTTGCTCAACCTCTGGAGGTTTTCCAGAGCCTCACCTCT
CCTGGTTGGAAAATGGAGAAGAATTAAATGCCATCAACACAACAGTTTCCCAAGATCCTGAAACTGAGC
TCTATGCTGTTAGCAGCAAACTGGATTTCAATATGACAACCAACCACAGCTTCATGTGTCTCATCAAGT
ATGGACATTTAAGAGTGAATCAGACCTTCAACTGGAATACAACCAAGCAAGAGCATTTTCCTGATAACC
TGCTCCCATCCTGGGCCATTACCTTAATCTCAGTAAATGGAATTTTTGTGATATGCTGCCTGACCTACT
GCTTTGCCCCAAGATGCAGAGAGAGAAGGAGGAATGAGAGATTGAGAAGGGAAAGTGTACGCCCTGTAT
AATCTAGAAGTTGTCTCCTCCTGCACTGACTGACTGATACAATCGATTTCTGGATCCGCAGGCCTCTGC
TAGCTTGACTGACTGAGATACAGCGTACCTTCAGCTCACAGACATGATAAGATACATTGATGAGTTTGG
ACAAACCACAACTAGAATGCAGTGAAAAAAATGCTTTATTTGTGAAATTTGTGATGCTATTGCTTTATT
TGTAACCATTATAAGCTGCAATAAACAAGTTAACAACAACAATTGCATTCATTTTATGTTTCAGGTTCA
GGGGGAGGTGTGGGAGGTTTTTAAAGCAAGTAAAACCTCTACAAATGTGGTAGTCGTCAGCTATCCTA
GGTCGCGATCTTATTCCCTTTAACTAATAAAAAAAATAATAAAGCATCACTTACTTAAAATCAGTTAG
CAAATTTCTGTCCAGTTTATTCAGCAGCACCTCCTTGCCCTCCTCCCAGCTCTGGTATTGCAGCTTCCT
CCTGGCTGCAAACTTTCTCCACAATCTAAATGGAATGTCAGTTTCCTCCTGTTCCTGTCCATCCGCACC
CACTATCTTCATGTTGTTGCAGATGAAGCGCGCAAGACCGTCTGAAGATACCTTCAACCCCGTGTATCC
ATATGACACGGAAACCGGTCCTCCAACTGTGCCTTTTCTTACTCCTCCCTTTGTATCCCCCAATGGGTT
TCAAGAGAGTCCCCCTGGGGTACTCTCTTTGCGCCTATCCGAACCTCTAGTTACCTCCAATGGCATGCT
TGCGCTCAAAATGGGCAACGGCCTCTCTCTGGACGAGGCCGGCAACCTTACCTCCCAAAATGTAACCAC
TGTGAGCCCACCTCTCAAAAAAACCAAGTCAAACATAAACCTGGAAATATCTGCACCCCTCACAGTTAC
CTCAGAAGCCCTAACTGTGGCTGCCGCCGCACCTCTAATGGTCGCGGGCAACACACTCACCATGCAATC
ACAGGCCCCGCTAACCGTGCACGACTCCAAACTTAGCATTGCCACCCAAGGACCCCTCACAGTGTCAGA
AGGAAAGCTAGCCCTGCAAACATCAGGCCCCCTCACCACCACCGATAGCAGTACCCTTACTATCACTGC
CTCACCCCCTCTAACTACTGCCACTGGTAGCTTGGGCATTGACTTGAAAGAGCCCATTTATACACAAAA
TGGAAAACTAGGACTAAAGTACGGGGCTCCTTTGCATGTAACAGACGACCTAAACACTTTGACCGTAGC
AACTGGTCCAGGTGTGACTATTAATAATACTTCCTTGCAAACTAAAGTTACTGGAGCCTTGGGTTTTGA
TTCACAAGGCAATATGCAACTTAATGTAGCAGGAGGACTAAGGATTGATTCTCAAAACAGACGCCTTAT
ACTTGATGTTAGTTATCCGTTTGATGCTCAAAACCAACTAAATCTAAGACTAGGACAGGGCCCTCTTTT
TATAAACTCAGCCCACAACTTGGATATTAACTACAACAAAGGCCTTTACTTGTTTACAGCTTCAAACAA
TTCCAAAAAGCTTGAGGTTAACCTAAGCACTGCCAAGGGGTTGATGTTTGACGCTACAGCCATAGCCAT
TAATGCAGGAGATGGGCTTGAATTTGGTTCACCTAATGCACCAAACACAAATCCCCTCAAAACAAAAT
TGGCCATGGCCTAGAATTTGATTCAAACAAGGCTATGGTTCCTAAACTAGGAACTGGCCTTAGTTTTGA
CAGCACAGGTGCCATTACAGTAGGAAACAAAATAATGATAAGCTAACTTTGTGGACCACACCAGCTCC
ATCTCCTAACTGTAGACTAAATGCAGAGAAGATGCTAAACTCACTTGGTCTTAACAAAATGTGGCAG
TCAAATACTTGCTACAGTTTCAGTTTTGGCTGTTAAAGGCAGTTTGGCTCCAATATCTGGAACAGTTCA
AAGTGCTCATCTTATTATAAGATTTGACGAAAATGGAGTGCTACTAAACAATTCCTTCCTGGACCCAGA
ATATTGGAACTTTAGAAATGGAGATCTTACTGAAGGCACAGCCTATACAAACGCTGTTGGATTTATGCC
TAACCTATCAGCTTATCCAAAATCTCACGGTAAAACTGCCAAAAGTAACATTGTCAGTCAAGTTTACTT
AAACGGAGACAAAACTAAACCTGTAACACTAACCATTACACTAAACGGTACACAGGAAACAGGAGACAC
AACTCCAAGTGCATACTCTATGTCATTTTCATGGGACTGGTCTGGCCACAACTACATTAATGAAATATT
TGCCACATCCTCTTACACTTTTTCATACATTGCCCAAGAATAAAGAATCGTTTGTGTTATGTTTCAACG
TGTTTATTTTCAATTGCAGAAAATTTCAAGTCATTTTTCATTCAGTAGTATAGCCCCACCACCACATA
GCTTATACAGATCACCGTACCTTAATCAAACTCACAGAACCCTAGTATTCAACCTGCCACCTCCCTCCC
AACACACAGAGTACACAGTCCTTTCTCCCCGGCTGGCCTTAAAAAGCATCATATCATGGGTAACAGACA
TATTCTTAGGTGTTATATTCCACACGGTTTCCTGTCGAGCCAAACGCTCATCAGTGATATTAATAAACT
CCCCGGGCAGCTCACTTAAGTTCATGTCGCTGTCCAGCTGCTGAGCCACAGGCTGCTGTCCAACTTGCG
GTTGCTTAACGGGCGGCGAAGGAGAAGTCCACGCCTACATGGGGGTAGAGTCATAATCGTGCATCAGGA
```

Figure 72 continued

```
TAGGGCGGTGGTGCTGCAGCAGCGCGCGAATAAACTGCTGCCGCCGCCGCTCCGTCCTGCAGGAATACA
ACATGGCAGTGGTCTCCTCAGCGATGATTCGCACCGCCCGCAGCATAAGGCGCCTTGTCCTCCGGGCAC
AGCAGCGCACCCTGATCTCACTTAAATCAGCACAGTAACTGCAGCACAGCACCACAATATTGTTCAAAA
TCCCACAGTGCAAGGCGCTGTATCCAAAGCTCATGGCGGGGACCACAGAACCCACGTGGCCATCATACC
ACAAGCGCAGGTAGATTAAGTGGCGACCCCTCATAAACACGCTGGACATAAACATTACCTCTTTTGGCA
TGTTGTAATTCACCACCTCCCGGTACCATATAAACCTCTGATTAAACATGGCGCCATCCACCACCATCC
TAAACCAGCTGGCCAAAACCTGCCCGCCGGCTATACACTGCAGGGAACCGGGACTGGAACAATGACAGT
GGAGAGCCCAGGACTCGTAACCATGGATCATCATGCTCGTCATGATATCAATGTTGGCACAACACAGGC
ACACGTGCATACACTTCCTCAGGATTACAAGCTCCTCCCGCGTTAGAACCATATCCCAGGGAACAACCC
ATTCCTGAATCAGCGTAAATCCCACACTGCAGGGAAGACCTCGCACGTAACTCACGTTGTGCATTGTCA
AGTGTTACATTCGGGCAGCAGCGGATGATCCTCCAGTATGGTAGCGCGGGTTTCTGTCTCAAAAGGAG
GTAGACGATCCCTACTGTACGGAGTGCGCCGAGACAACCGAGATCGTGTTGGTCGTAGTGTCATGCCAA
ATGGAACGCCGGACGTAGTCATATTTCCTGAAGCAAAACCAGGTGCGGGCGTGACAAACAGATCTGCGT
CTCCGGTCTCGCCGCTTAGATCGCTCTGTGTAGTAGTTGTAGTATATCCACTCTCTCAAAGCATCCAGG
CGCCCCCTGGCTTCGGGTTCTATGTAAACTCCTTCATGCGCCGCTGCCCTGATAACATCCACCACCGCA
GAATAAGCCACACCCAGCCAACCTACACATTCGTTCTGCGAGTCACACACGGGAGGAGCGGGAAGAGCT
GGAAGAACCATGTTTTTTTTTATTCCAAAAGATTATCCAAAACCTCAAAATGAAGATCTATTAAGTG
AACGCGCTCCCCTCCGGTGGCGTGGTCAAACTCTACAGCCAAAGAACAGATAATGGCATTTGTAAGATG
TTGCACAATGGCTTCCAAAAGGCAAACGGCCCTCACGTCCAAGTGGACGTAAAGGCTAAACCCTTCAGG
GTGAATCTCCTCTATAAACATTCCAGCACCTTCAACCATGCCCAAATAATTCTCATCTCGCCACCTTCT
CAATATATCTCTAAGCAAATCCCGAATATTAAGTCCGGCCATTGTAAAAATCTGCTCCAGAGCGCCCTC
CACCTTCAGCCTCAAGCAGCGAATCATGATTGCAAAAATTCAGGTTCCTCACAGACCTGTATAAGATTC
AAAAGCGGAACATTAACAAAAATACCGCGATCCCGTAGGTCCCTTCGCAGGGCCAGCTGAACATAATCG
TGCAGGTCTGCACGGACCAGCGCGGCCACTTCCCCGCCAGGAACCATGACAAAAGAACCCACACTGATT
ATGACACGCATACTCGGAGCTATGCTAACCAGCGTAGCCCCGATGTAAGCTTGTTGCATGGGCGGCGAT
ATAAAATGCAAGGTGCTGCTCAAAAAATCAGGCAAAGCCTCGCGCAAAAAAGAAAGCACATCGTAGTCA
TGCTCATGCAGATAAAGGCAGGTAAGCTCCGGAACCACCACAGAAAAAGACACCATTTTCTCTCAAAC
ATGTCTGCGGGTTTCTGCATAAACACAAAATAAAATAACAAAAAAACATTTAAACATTAGAAGCCTGTC
TTACAACAGGAAAAACAACCCTTATAAGCATAAGACGGACTACGGCCATGCCGGCGTGACCGTAAAAAA
ACTGGTCACCGTGATTAAAAAGCACCACCGACAGCTCCTCGGTCATGTCCGGAGTCATAATGTAAGACT
CGGTAAACACATCAGGTTGATTCACATCGGTCAGTGCTAAAAAGCGACCGAAATAGCCCGGGGGAATAC
ATACCCGCAGGCGTAGAGACAACATTACAGCCCCCATAGGAGGTATAACAAAATTAATAGGAGAGAAAA
ACACATAAACACCTGAAAAACCCTCCTGCCTAGGCAAAATAGCACCCTCCCGCTCCAGAACAACATACA
GCGCTTCCACAGCGGCAGCCATAACAGTCAGCCTTACCAGTAAAAAGAAAACCTATTAAAAAAACACC
ACTCGACACGGCACCAGCTCAATCAGTCACAGTGTAAAAAGGGCCAAGTGCAGAGCGAGTATATATAG
GACTAAAAAATGACGTAACGGTTAAAGTCCACAAAAAACACCCAGAAAACCGCACGCGAACCTACGCCC
AGAAACGAAAGCCAAAAAACCCACAACTTCCTCAAATCGTCACTTCCGTTTTCCCACGTTACGTAACTT
CCCATTTTAAGAAAACTACAATTCCCAACACATACAAGTTACTCCGCCCTAAAACCTACGTCACCCGCC
CCGTTCCCACGCCCCGCGCCACGTCACAAACTCCACCCCCTCATTATCATATTGGCTTCAATCCAAAAT
AAGGTATATTATTGATGATG
```

VIRUS ENCODING AN ANTI-TCR-COMPLEX ANTIBODY OR FRAGMENT

The present disclosure relates to an oncolytic virus comprising a transgene encoding at least an agonistic antibody or binding fragment thereof to the antigen-specific T-cell receptor complex (TCR), such as an anti-CD3 antibody (including a binding fragment thereof), for expression on the surface of a cancer cell, compositions comprising the same and use of said virus and composition for the treatment of cancer.

The present application is a 35 U.S.C. § 371 national phase application from, and claims priority to, International Application No. PCT/EP2016/081818, filed Dec. 19, 2016, and published under PCT Article 21(2) in English, which designated the U.S., and claims the benefit of priority from United Kingdom Patent Application Nos. GB1522334.0 filed on Dec. 17, 2015, GB1607463.5 filed on Apr. 29, 2016, GB1617207.4 filed on Oct. 10, 2016, and GB1617206.6 filed on Oct. 10, 2016, each of which are incorporated by reference herein into this application in their entirety including all tables, figures and claims.

BACKGROUND

Cancer is still a huge social burden to society in terms of the hardship and suffering of patients and their loved ones, and also in terms of the high financial cost of treating, caring for and supporting patients. It is now thought that the immune systems of healthy individuals clear cancerous cells routinely. However, in those patients with cancer one or more of the defense mechanisms involved in this clearance is/are down regulated or turned off completely.

It is now known that tumors change their microenvironment to make it more permissive to their growth. This occurs by the tumor releasing extracellular signals that, for example, promote tumor angiogenesis and/or induce local immune suppression or immune tolerance.

The T-cell receptor complex (TCR) on T-cells recognizes a particular antigen specifically when the antigen is in the form of peptide presented on a major histocompatibility (MHC) molecule on a cell surface. The T-cell receptor complex (TCR) comprises an antigen-binding heterodimer of alpha and beta or gamma and delta chains, together with the immunoglobulin family proteins CD3 epsilon, delta, gamma and zeta chains. The surface CD3 epsilon, delta and gamma chains play important roles in assembly of the TCR complex and stable surface expression. The zeta chain homodimer is almost completely intracellular and functions as the key signaling molecule of the complex when the TCR complex is cross-linked physiologically by antigen-MHC complexes on cell surfaces or by pharmacological modalities, for example antibodies to the TCR complex such as an anti-CD3 antibody (including a binding fragment thereof).

It is clear from many different preclinical and clinical studies that the microenvironment within tumours can suppress the development and activity of anti-tumour immune responses, with a wide variety of mechanisms being shown to potentially play a role. In particular immuno-suppressive mechanisms ultimately prevent T-cell responses from mediating the killing of tumour cells. Suppressive mechanisms may include the exclusion of T-cells from entering tumour tissues, inhibiting activation or activity of T-cells that do enter the tumour and the modulation of tumour cell proteins which reduces the ability of T-cells to recognize or respond to them. The importance of such immunosuppressive pathways in supporting tumour progression has been particularly highlighted by the clinical efficacy shown by antibodies to receptors in two such suppressive pathways, CTLA4 and PD-1/PDL1, which has led to their marketing approval for the treatment of melanoma and other cancers.

Whilst adoptive transfer of T cells stimulated in vitro has been proposed to provide activated cytolytic T cells, for example for the treatment of cancers such as a nasopharyngeal cancer, this can be a difficult, expensive and inconvenient therapy. Furthermore, sometimes these therapies are only effective in specific patient sub-groups.

Some clinical trials have been performed with cancer antigens, for example MAGE, in the form a vaccine containing a cancer antigen and adjuvant, such as monophosphoryl A and CpG. However, these approaches have failed to deliver the high clinical successes that were anticipated. Thus true in vivo stimulation or activation of T cells focused on cancer cells for the treatment of cancer is not a practical reality and the present time.

The present inventors have generated data showing that cancer cells that are made to express at least an agonistic anti-TCR antibody or binding fragment on their surface are dealt with more effectively by the immune system than unmodified cancer cells which don't express the protein on their surface.

Whilst not wishing to be bound by theory the present inventors believe that making the cancer cell express at least an agonistic anti-TCR antibody is a way of focusing or kickstarting a patient's immune system to fight the cancer, for example the anti-TCR antibody or binding fragment thereof may engage and/or activate T cells. Such activation of T-cells that physiologically would recognize cancer-specific antigens, including patient-specific neoantigens, can also lead to generation of effector and memory T-cell progeny that can migrate to regions of the same tumour or other tumour sites (e.g. metastases) not expressing an agonistic anti-TCR antibody or fragment thereof. Thus this therapy has the potential to generate an extended immune response in the form of activated T cells to cancer cells expressing their physiological cancer-specific antigen to fight the cancer systemically in the patient.

Clearly a cancer treatment that engages the body's own immune responses to fight the cancer would be extremely advantageous. Furthermore, the therapy is very focused on cancer cells and thus the off-targets effects and toxicities are likely to be much less than traditional therapies, such as chemotherapy.

The cancer cell can be made to express an anti-TCR antibody or binding fragment thereof by infecting the cancer cell with a replication competent oncolytic virus or a replication deficient oncolytic viral vector encoding an anti-TCR antibody or a binding fragment thereof.

SUMMARY OF THE DISCLOSURE

The present disclosure provides:
1. A replication deficient oncolytic viral vector or replication capable oncolytic virus encoding an antibody or a binding fragment thereof to the antigen-specific T-cell receptor complex (TCR) (such as an anti-CD3 antibody or binding fragment thereof) for expression on the surface of a cancer cell.
2. A replication deficient oncolytic viral vector or replication capable oncolytic virus according to paragraph 1, wherein the virus is replication competent.
3. A replication deficient oncolytic viral vector or replication capable oncolytic virus according to paragraph 1, wherein the virus is replication deficient.

4. A replication deficient oncolytic viral vector or replication competent oncolytic virus according to any one of paragraph 1 to 3 wherein the encoded antibody further comprises a transmembrane domain or a GPI anchor.
5. A replication deficient oncolytic viral vector or replication competent oncolytic virus according to paragraph 4, wherein the transmembrane domain is selected from a sequence shown in SEQ ID NO: 10 to 14.
6. A replication deficient oncolytic viral vector or replication competent oncolytic virus according to any one of claims 1 to 5, wherein the oncolytic virus is selected from an adenovirus (such as Ad5, Ad3, Ad11, Ad35, Ad11/Ad3 and Ad5/3 or a derivative thereof), herpes simplex virus (such as HSV-1), vesicular stomatitis virus, reovirus, vaccina virus, Seneca valley virus, coxsackievirus, measles, Maraba virus and Newcastle disease virus, or for example selected from Oncorine (H101), Talimogene laparepvec, Reolysin, Pexastimogene devacirepvec (JX-594), Cavatak, Seprehvir, CGTG-102, MV-NIS, PV701, CL-ONC1, CG0070, and enadenotucirev (EnAd).
7. A replication deficient oncolytic viral vector or replication competent oncolytic virus according to paragraph 6, wherein the oncolytic virus is an adenovirus.
8. A replication deficient oncolytic viral vector or replication competent oncolytic virus according to paragraph 7, wherein the oncolytic adenovirus is a group B virus, such as Ad11 or a derivative thereof.
9. A replication deficient oncolytic viral vector or replication competent oncolytic virus according to paragraph 8, wherein the oncolytic adenovirus is EnAd.
10. A replication deficient oncolytic viral vector or replication competent oncolytic virus according to paragraph 7, wherein the oncolytic adenovirus is a group C virus, such as Ad5 or a derivative thereof.
11. A replication deficient oncolytic viral vector or replication competent oncolytic virus according to paragraph 6, wherein the oncolytic virus a herpes virus, such as HSV-1.
12. A replication deficient oncolytic viral vector or replication competent oncolytic virus according to paragraph 6, wherein the oncolytic virus is a vaccina virus.
13. A replication deficient oncolytic viral vector or replication competent oncolytic virus according to paragraph 6, wherein the oncolytic virus is a measles virus.
14. A replication deficient oncolytic viral vector or replication competent oncolytic virus according to any one of paragraph 1 to 13, wherein the antibody or binding fragment is selected from the group comprising a full length antibody, a Fab, modified Fab, Fab', modified Fab', F(ab')2, Fv, single domain antibodies, scFv, bi, tri or tetra-valent antibodies, Bis-scFv, diabodies, triabodies, tetrabodies, humabodies, disulfide stabilised forms of any one of the same and epitope-binding fragments thereof.
15. A replication deficient oncolytic viral vector or replication competent oncolytic virus according to paragraph 1 to 14 wherein the antibody binding fragment is a single chain Fv.
16. A replication deficient oncolytic viral vector or replication competent oncolytic virus according to any one of claims 1 to 15, wherein the oncolytic virus encodes at least one further transgene.
17. A replication deficient oncolytic viral vector or replication competent oncolytic virus according to paragraph 16, wherein the oncolytic virus encodes at least two further transgenes.
18. A replication deficient oncolytic viral vector or replication competent oncolytic virus according to paragraph 16 or 17, wherein the further transgene(s) encodes a protein independently selected from the group comprising a cytokine, a chemokine, an antagonistic antibody molecule or binding fragment thereof, an agonistic antibody molecule or binding fragment thereof, an immunomodulator, an enzyme and combinations thereof.
19. A replication deficient oncolytic viral vector or replication competent oncolytic virus according to paragraph 18, wherein at least one further transgene encodes an antibody molecule or a binding fragment thereof (for example which may be in a surface expressed form and/or secreted form).
20. A replication deficient oncolytic viral vector or replication competent oncolytic virus according to paragraph 19, wherein the antibody molecule or binding fragment is an inhibitor.
21. A replication deficient oncolytic viral vector or a replication competent oncolytic virus according to paragraph 20, wherein the inhibitor is an inhibitor of an angiogenesis factor or an inhibitor of a T cell deactivating factor.
22. A replication deficient oncolytic viral vector or a replication competent oncolytic virus according to any one of paragraphs 19 or 21 wherein the antibody molecule or binding fragment comprises a binding domains specific to an antigen independently selected from CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2,
23. A replication deficient oncolytic viral vector or a replication competent oncolytic virus according to any one of paragraphs 19 or 23 wherein the antibody molecule or binding fragment comprises a binding domains specific to an antigen independently selected from FGF, VEGF, VEGFR and NRP-1, PDGF, PDGFR, TGF-β, endoglin, TGF-β receptors, CCL2, $\alpha_v\beta_3$, $\alpha_v\beta_5$, $\alpha_5\beta_1$, VE-cadherin, CD31, ephrin, a plasminogen activator, plasminogen activator inhibitor-1, AC133, 1D1/1D3, class 3 semaphorins and combinations thereof.
24. A replication deficient oncolytic viral vector or a replication competent oncolytic virus according to any one of paragraphs 19 to 21, wherein the antibody molecule or binding fragment thereof (in particular a secreted antibody as opposed to a cell surface expressed antibody) comprises a binding domain specific to a cancer antigen, for example MAGE, PRAME, NYESO, WT-1, CA-125, tyrosinase, MUC-1, CEA, alphafetoprotein (AFP), HER1, HER2, HER3, HER4, CD52, CD30, CD19 and combinations thereof.
25. A replication deficient oncolytic viral vector or a replication competent oncolytic virus according to any one of paragraph 19 to 24, wherein antibody molecule or binding fragment is an agonist.
26. A replication deficient oncolytic viral vector or a replication competent oncolytic virus according to paragraph 25, wherein the agonist is independently selected from the group comprising an antibody molecule or binding fragment comprising a binding domain specific to CD40, CD40 ligand (also known as CD154), GITR, OX40, CD27, 4-1BB and a combination thereof, such as CD40, GITR, OX40, CD27 and 4-1BB.
27. A replication deficient oncolytic viral vector or a replication competent oncolytic virus according to paragraph 26 wherein the antibody molecule or binding fragment thereof comprises a binding domain specific to CD40L.
28. A replication deficient oncolytic viral vector or a replication competent oncolytic virus according to paragraph 26 or 27 wherein the antibody molecule or binding fragment thereof comprises a binding domain specific to CD40.

29. A replication deficient oncolytic viral vector or a replication competent oncolytic virus according to any one of paragraphs 26 to 28 wherein the antibody molecule or binding fragment thereof comprises a binding domain specific to GITR.

30. A replication deficient oncolytic viral vector or a replication competent oncolytic virus according to any one of paragraphs 26 to 29 wherein the antibody molecule or binding fragment thereof comprises a binding domain specific to OX40.

31. A replication deficient oncolytic viral vector or a replication competent oncolytic virus according to any one of paragraphs 26 to 30 wherein the antibody molecule or binding fragment thereof comprises a binding domain specific to CD27.

32. A replication deficient oncolytic viral vector or a replication competent oncolytic virus according to any one of paragraphs 26 to 31 wherein the antibody molecule or binding fragment thereof comprises a binding domain specific to 4-1BB.

33. A replication deficient oncolytic viral vector or a replication competent oncolytic virus according to any one of paragraph 18 to 32, where the immunomodulator is a membrane-associated protein ligand for an immune cell surface receptors independently selected from the group comprising CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1, PD-L2, CD16, CD25, CD33, CD332, CD127, CD31, CD43, CD44, CD162, CD301a, CD301b and Galectin-3, FLT-3, FLT-3 ligand, TLRs, TLR ligands, CCR7, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILI'S, ILT7, TSLP Receptor, CD141, CD303, CADM1, CLEC9a, XCR1 and CD304, OX40, OX40 ligand, CD27, CD28, CD30, CD40, CD40 ligand, CD70, CD137, GITR, 4-1BB, ICOS, ICOS ligand and combinations thereof.

34. A replication deficient oncolytic viral vector or a replication competent oncolytic virus according to paragraph 33, wherein membrane-associated protein ligand for an immune cell surface receptor is or binds to CTLA-4.

35. A replication deficient oncolytic viral vector or a replication competent oncolytic virus according to paragraph 33 or 34, wherein the membrane-associated protein ligand for an immune cell surface receptor is or binds to PD-1.

36. A replication deficient oncolytic viral vector or a replication competent oncolytic virus according to any one of paragraphs 33 to 35, wherein the membrane-associated protein ligand for an immune cell surface receptor is or binds to PD-L1.

37. A replication deficient oncolytic viral vector or a replication competent oncolytic virus according to any one of paragraphs 33 to 36, wherein the membrane-associated protein ligand for an immune cell surface receptor is or binds to PD-L2.

38. A replication deficient oncolytic viral vector or a replication competent oncolytic virus according to any one of paragraphs 33 to 37, wherein the membrane-associated protein ligand for an immune cell surface receptor is or binds to VISTA.

39. A replication deficient oncolytic viral vector or a replication competent oncolytic virus according to any one of paragraphs 33 to 38, wherein the membrane-associated protein ligand for an immune cell surface receptor is or binds to B7-H3.

40. A replication deficient oncolytic viral vector or a replication competent oncolytic virus according to any one of paragraphs 33 to 39, wherein the membrane-associated protein ligand for an immune cell surface receptor is or binds to B7-H4.

41. A replication deficient oncolytic viral vector or a replication competent oncolytic virus according to any one of paragraphs 33 to 40, wherein the membrane-associated protein ligand for an immune cell surface receptor is or binds to HVEM.

42. A replication deficient oncolytic viral vector or a replication competent oncolytic virus according to any one of paragraphs 33 to 41, wherein the membrane-associated protein ligand for an immune cell surface receptor is or binds to ILT-2.

43. A replication deficient oncolytic viral vector or a replication competent oncolytic virus according to any one of paragraphs 33 to 42, wherein the membrane-associated protein ligand for an immune cell surface receptor is or binds to ILT-3.

44. A replication deficient oncolytic viral vector or a replication competent oncolytic virus according to any one of paragraphs 33 to 43, wherein the membrane-associated protein ligand for an immune cell surface receptor is or binds to ILT-4.

45. A replication deficient oncolytic viral vector or a replication competent oncolytic virus according to any one of paragraphs 33 to 44, wherein the membrane-associated protein ligand for an immune cell surface receptor is or binds to TIM-3.

46. A replication deficient oncolytic viral vector or a replication competent oncolytic virus according to any one of paragraphs 33 to 45, wherein the membrane-associated protein ligand for an immune cell surface receptor is or binds to LAG-3.

47. A replication deficient oncolytic viral vector or a replication competent oncolytic virus according to any one of paragraphs 33 to 46, wherein the membrane-associated protein ligand for an immune cell surface receptor is or binds to BTLA.

48. A replication deficient oncolytic viral vector or a replication competent oncolytic virus according to any one of paragraphs 33 to 47, wherein the membrane-associated protein ligand for an immune cell surface receptor is or binds to LIGHT.

49. A replication deficient oncolytic viral vector or a replication competent oncolytic virus according to any one of paragraphs 33 to 48, wherein the membrane-associated protein ligand for an immune cell surface receptor is or binds to CD160.

50. A replication deficient oncolytic viral vector or a replication competent oncolytic virus according to any one of paragraphs 33 to 49, wherein the membrane-associated protein ligand for an immune cell surface receptor is or binds to CD16.

51. A replication deficient oncolytic viral vector or a replication competent oncolytic virus according to any one of paragraphs 33 to 50, wherein the membrane-associated protein ligand for an immune cell surface receptor is or binds to CD25.

52. A replication deficient oncolytic viral vector or a replication competent oncolytic virus according to any one of paragraphs 33 to 51, wherein the membrane-associated protein ligand for an immune cell surface receptor is or binds to CD33.

53. A replication deficient oncolytic viral vector or a replication competent oncolytic virus according to any one of paragraph 33 to 52, wherein the membrane-associated protein ligand for an immune cell surface receptor is or binds to CD332.
54. A replication deficient oncolytic viral vector or a replication competent oncolytic virus according to any one of paragraphs 33 to 53, wherein the membrane-associated protein ligand for an immune cell surface receptor is or binds to CD127.
55. A replication deficient oncolytic viral vector or a replication competent oncolytic virus according to any one of paragraphs 33 to 54, wherein the membrane-associated protein ligand for an immune cell surface receptor is or binds to CD31.
56. A replication deficient oncolytic viral vector or a replication competent oncolytic virus according to any one of paragraphs 33 to 55, wherein the membrane-associated protein ligand for an immune cell surface receptor is or binds to CD43.
57. A replication deficient oncolytic viral vector or a replication competent oncolytic virus according to any one of paragraphs 33 to 56, wherein the membrane-associated protein ligand for an immune cell surface receptor is or binds to CD44.
58. A replication deficient oncolytic viral vector or a replication competent oncolytic virus according to any one of paragraphs 33 to 57, wherein the membrane-associated protein ligand for an immune cell surface receptor is or binds to CD162.
59. A replication deficient oncolytic viral vector or a replication competent oncolytic virus according to any one of paragraphs 33 to 58, wherein the membrane-associated protein ligand for an immune cell surface receptor is or binds to CD301a.
60. A replication deficient oncolytic viral vector or a replication competent oncolytic virus according to any one of paragraphs 33 to 59, wherein the membrane-associated protein ligand for an immune cell surface receptor is or binds CD301b.
61. A replication deficient oncolytic viral vector or a replication competent oncolytic virus according to any one of paragraphs 33 to 60, wherein the membrane-associated protein ligand for an immune cell surface receptor is or binds Galectin-3.
62. A replication deficient oncolytic viral vector or a replication competent oncolytic virus according to any one of paragraphs 33 to 61, wherein the membrane-associated protein ligand for an immune cell surface receptor is or binds FLT-3.
63. A replication deficient oncolytic viral vector or a replication competent oncolytic virus according to any one of paragraphs 33 to 62, wherein the membrane-associated protein ligand for an immune cell surface receptor is FLT-3 ligand.
64. A replication deficient oncolytic viral vector or a replication competent oncolytic virus according to any one of paragraphs 33 to 63, wherein the membrane-associated protein ligand for an immune cell surface receptor is a TLR.
65. A replication deficient oncolytic viral vector or a replication competent oncolytic virus according to any one of paragraphs 33 to 64, wherein the membrane-associated protein ligand for an immune cell surface receptor is a TLR-ligand.
66. A replication deficient oncolytic viral vector or a replication competent oncolytic virus according to any one of paragraphs 33 to 65, wherein the membrane-associated protein ligand for an immune cell surface receptor is or binds to CCR7.
67. A replication deficient oncolytic viral vector or a replication competent oncolytic virus according to any one of paragraphs 33 to 66, wherein the membrane-associated protein ligand for an immune cell surface receptor is or binds to CD1a.
68. A replication deficient oncolytic viral vector or a replication competent oncolytic virus according to any one of paragraphs 33 to 67, wherein the membrane-associated protein ligand for an immune cell surface receptor is or binds to CD1c.
69. A replication deficient oncolytic viral vector or a replication competent oncolytic virus according to any one of paragraphs 33 to 68, wherein the membrane-associated protein ligand for an immune cell surface receptor is or binds to CD11b.
70. A replication deficient oncolytic viral vector or a replication competent oncolytic virus according to any one of paragraphs 33 to 69, wherein the membrane-associated protein ligand for an immune cell surface receptor is or binds to CD11c.
71. A replication deficient oncolytic viral vector or a replication competent oncolytic virus according to any one of paragraphs 33 to 70, wherein the membrane-associated protein ligand for an immune cell surface receptor is CD80.
72. A replication deficient oncolytic viral vector or a replication competent oncolytic virus according to any one of paragraphs 33 to 71, wherein the membrane-associated protein ligand for an immune cell surface receptor is or binds to CD83.
73. A replication deficient oncolytic viral vector or a replication competent oncolytic virus according to any one of paragraphs 33 to 72, wherein the membrane-associated protein ligand for an immune cell surface receptor is CD86.
74. A replication deficient oncolytic viral vector or a replication competent oncolytic virus according to any one of paragraphs 33 to 73, wherein the membrane-associated protein ligand for an immune cell surface receptor is or binds to CD123.
75. A replication deficient oncolytic viral vector or a replication competent oncolytic virus according to any one of paragraphs 33 to 74, wherein the membrane-associated protein ligand for an immune cell surface receptor is or binds to CD172a.
76. A replication deficient oncolytic viral vector or a replication competent oncolytic virus according to any one of paragraphs 33 to 75, wherein the membrane-associated protein ligand for an immune cell surface receptor is or binds to CD205.
77. A replication deficient oncolytic viral vector or a replication competent oncolytic virus according to any one of paragraphs 33 to 76, wherein the membrane-associated protein ligand for an immune cell surface receptor is or binds to CD207.
78. A replication deficient oncolytic viral vector or a replication competent oncolytic virus according to any one of paragraphs 33 to 77, wherein the membrane-associated protein ligand for an immune cell surface receptor is or binds to CD209.
79. A replication deficient oncolytic viral vector or a replication competent oncolytic virus according to any one of paragraphs 33 to 78, wherein the membrane-associated protein ligand for an immune cell surface receptor is or binds to CD273.
80. A replication deficient oncolytic viral vector or a replication competent oncolytic virus according to any one of paragraphs 33 to 79, wherein the membrane-associated protein ligand for an immune cell surface receptor is or binds to CD281.
81. A replication deficient oncolytic viral vector or a replication competent oncolytic virus according to any one of paragraphs 33 to 80, wherein the membrane-associated protein ligand for an immune cell surface receptor is or binds to CD283.
82. A replication deficient oncolytic viral vector or a replication competent oncolytic virus according to any one of paragraphs 33 to 81, wherein the membrane-associated protein ligand for an immune cell surface receptor is or binds to CD286.
83. A replication deficient oncolytic viral vector or a replication competent oncolytic virus according to any one of paragraphs 33 to 82, wherein the membrane-associated protein ligand for an immune cell surface receptor is or binds to CD289.
84. A replication deficient oncolytic viral vector or a replication competent oncolytic virus according to any one of paragraphs 33 to 83, wherein the membrane-associated protein ligand for an immune cell surface receptor is or binds to CD287.
85. A replication deficient oncolytic viral vector or a replication competent oncolytic virus according to any one of paragraphs 33 to 84, wherein the membrane-associated protein ligand for an immune cell surface receptor is or binds to CXCR4.
86. A replication deficient oncolytic viral vector or a replication competent oncolytic virus according to any one of paragraphs 33 to 85, wherein the membrane-associated protein ligand for an immune cell surface receptor is or binds to GITR ligand.
87. A replication deficient oncolytic viral vector or a replication competent oncolytic virus according to any one of paragraphs 33 to 86, wherein the membrane-associated protein ligand for an immune cell surface receptor binds to IFN-α2.
88. A replication deficient oncolytic viral vector or a replication competent oncolytic virus according to any one of paragraphs 33 to 87, wherein the membrane-associated protein ligand for an immune cell surface receptor is IL-12.
89. A replication deficient oncolytic viral vector or a replication competent oncolytic virus according to any one of paragraphs 33 to 88, wherein the membrane-associated protein ligand for an immune cell surface receptor is IL-23.
90. A replication deficient oncolytic viral vector or a replication competent oncolytic virus according to any one of paragraphs 33 to 89, wherein the membrane-associated protein ligand for an immune cell surface receptor binds to ILT1.
91. A replication deficient oncolytic viral vector or a replication competent oncolytic virus according to any one of paragraphs 33 to 90, wherein the membrane-associated protein ligand for an immune cell surface receptor binds to ILI'S.
92. A replication deficient oncolytic viral vector or a replication competent oncolytic virus according to any one of paragraphs 33 to 91, wherein the membrane-associated protein ligand for an immune cell surface receptor binds to ILT7.
93. A replication deficient oncolytic viral vector or a replication competent oncolytic virus according to any one of paragraphs 33 to 92, wherein the membrane-associated protein ligand for an immune cell surface receptor binds to TSLP Receptor.
94. A replication deficient oncolytic viral vector or a replication competent oncolytic virus according to any one of paragraphs 33 to 93, wherein the membrane-associated protein ligand for an immune cell surface receptor is or binds to CD141.
95. A replication deficient oncolytic viral vector or a replication competent oncolytic virus according to any one of paragraphs 33 to 94, wherein the membrane-associated protein ligand for an immune cell surface receptor is or binds to CD303.
96. A replication deficient oncolytic viral vector or a replication competent oncolytic virus according to any one of paragraphs 33 to 95, wherein the membrane-associated protein ligand for an immune cell surface receptor is or binds to CADM1.
97. A replication deficient oncolytic viral vector or a replication competent oncolytic virus according to any one of paragraphs 33 to 96, wherein the membrane-associated protein ligand for an immune cell surface receptor is or binds to CLEC9a.
98. A replication deficient oncolytic viral vector or a replication competent oncolytic virus according to any one of paragraphs 33 to 96, wherein the membrane-associated protein ligand for an immune cell surface receptor is or binds to XCR1.
99. A replication deficient oncolytic viral vector or a replication competent oncolytic virus according to any one of paragraphs 33 to 98, wherein the membrane-associated protein ligand for an immune cell surface receptor is or binds to CD304.
100. A replication deficient oncolytic viral vector or a replication competent oncolytic virus according to any one of paragraphs 33 to 99, wherein the membrane-associated protein ligand for an immune cell surface receptor is or binds to OX40.
101. A replication deficient oncolytic viral vector or a replication competent oncolytic virus according to any one of paragraphs 33 to 100, wherein the membrane-associated protein ligand for an immune cell surface receptor is or binds to OX40 ligand.
102. A replication deficient oncolytic viral vector or a replication competent oncolytic virus according to any one of paragraphs 33 to 101, wherein the membrane-associated protein ligand for an immune cell surface receptor is or binds to CD27.
103. A replication deficient oncolytic viral vector or a replication competent oncolytic virus according to any one of paragraphs 33 to 102, wherein the membrane-associated protein ligand for an immune cell surface receptor is or binds to CD28.
104. A replication deficient oncolytic viral vector or a replication competent oncolytic virus according to any one of paragraphs 33 to 103, wherein the membrane-associated protein ligand for an immune cell surface receptor is or binds to CD30.
105. A replication deficient oncolytic viral vector or a replication competent oncolytic virus according to any one of paragraphs 33 to 104, wherein the membrane-associated protein ligand for an immune cell surface receptor is or binds to CD40.
106. A replication deficient oncolytic viral vector or a replication competent oncolytic virus according to any one of paragraphs 33 to 105, wherein the membrane-associated protein ligand for an immune cell surface receptor is or binds to CD40 ligand.
107. A replication deficient oncolytic viral vector or a replication competent oncolytic virus according to any one of paragraphs 33 to 106, wherein the membrane-associated protein ligand for an immune cell surface receptor is or binds to CD70.

108. A replication deficient oncolytic viral vector or a replication competent oncolytic virus according to any one of paragraphs 33 to 107, wherein the membrane-associated protein ligand for an immune cell surface receptor is or binds to CD137.

109. A replication deficient oncolytic viral vector or a replication competent oncolytic virus according to any one of paragraphs 33 to 108, wherein the membrane-associated protein ligand for an immune cell surface receptor is or binds to GITR.

110. A replication deficient oncolytic viral vector or a replication competent oncolytic virus according to any one of paragraphs 33 to 109, wherein the membrane-associated protein ligand for an immune cell surface receptor is or binds to 4-1BB.

111. A replication deficient oncolytic viral vector or a replication competent oncolytic virus according to any one of paragraphs 33 to 110, wherein the membrane-associated protein ligand for an immune cell surface receptor is or binds to ICOS.

112. A replication deficient oncolytic viral vector or a replication competent oncolytic virus according to any one of paragraphs 33 to 111, wherein the membrane-associated protein ligand for an immune cell surface receptor is or binds to ICOS ligand.

113. A replication deficient oncolytic viral vector or replication competent oncolytic virus according to any one of paragraph 18 to 112, wherein at least one further transgene encodes a cytokine (including secreted and/or cell membrane associated molecule).

114. A replication deficient oncolytic viral vector or replication competent oncolytic virus according to any one of paragraph 17 to 113, wherein a second further transgene encodes a cytokine (including secreted or cell membrane associated molecules).

115. A replication deficient oncolytic viral vector or replication competent oncolytic virus according to any one of paragraph 18 to 114, wherein the encoded cytokine is selected from TNF alpha super family (TNFRSF includes TNF-alpha, TNF-C, OX40L, CD154, FasL, LIGHT, TL1A, CD70, Siva, CD153, 4-1BB ligand, TRAIL, RANKL, TWEAK, APRIL, BAFF, CAMLG, NGF, BDNF, NT-3, NT-4, GITR ligand, EDA-A, EDA-A2), TGF-beta superfamily, IL-1 family (i.e. IL-1 and IL-8), IL-2 family, IL-10 family, IL-17 family, interferon family.

116. A replication deficient oncolytic viral vector or replication competent oncolytic virus according to paragraph 115, wherein the cytokine is TNF-alpha.

117. A replication deficient oncolytic viral vector or replication competent oncolytic virus according to paragraph 115 or 116, wherein the cytokine is TNF-C.

118. A replication deficient oncolytic viral vector or replication competent oncolytic virus according to any one of paragraphs 115 to 117, wherein the cytokine is OX40L.

119. A replication deficient oncolytic viral vector or replication competent oncolytic virus according to any one of paragraphs 115 to 118, wherein the cytokine is CD154.

120. A replication deficient oncolytic viral vector or replication competent oncolytic virus according to any one of paragraphs 115 to 119, wherein the cytokine is FasL.

121. A replication deficient oncolytic viral vector or replication competent oncolytic virus according to any one of paragraphs 115 to 120, wherein the cytokine is LIGHT.

122. A replication deficient oncolytic viral vector or replication competent oncolytic virus according to any one of paragraphs 115 to 121, wherein the cytokine is TL1A.

123. A replication deficient oncolytic viral vector or replication competent oncolytic virus according to any one of paragraphs 115 to 122, wherein the cytokine is CD70.

124. A replication deficient oncolytic viral vector or replication competent oncolytic virus according to any one of paragraphs 115 to 123, wherein the cytokine is Siva.

125. A replication deficient oncolytic viral vector or replication competent oncolytic virus according to any one of paragraphs 115 to 124, wherein the cytokine is CD153.

126. A replication deficient oncolytic viral vector or replication competent oncolytic virus according to any one of paragraphs 115 to 125, wherein the cytokine is 4-1BB ligand.

127. A replication deficient oncolytic viral vector or replication competent oncolytic virus according to any one of paragraphs 115 to 126, wherein the cytokine is TRAIL.

128. A replication deficient oncolytic viral vector or replication competent oncolytic virus according to any one of paragraphs 115 to 127, wherein the cytokine is RANKL.

129. A replication deficient oncolytic viral vector or replication competent oncolytic virus according to any one of paragraphs 115 to 128, wherein the cytokine is TWEAK.

130. A replication deficient oncolytic viral vector or replication competent oncolytic virus according to any one of paragraphs 115 to 129, wherein the cytokine is APRIL.

131. A replication deficient oncolytic viral vector or replication competent oncolytic virus according to any one of paragraphs 115 to 130, wherein the cytokine is BAFF.

132. A replication deficient oncolytic viral vector or replication competent oncolytic virus according to any one of paragraphs 115 to 131, wherein the cytokine is CAMLG.

133. A replication deficient oncolytic viral vector or replication competent oncolytic virus according to any one of paragraphs 115 to 132, wherein the cytokine is NGF.

134. A replication deficient oncolytic viral vector or replication competent oncolytic virus according to any one of paragraphs 115 to 133, wherein the cytokine is BDNF.

135. A replication deficient oncolytic viral vector or replication competent oncolytic virus according to any one of paragraphs 115 to 134, wherein the cytokine is NT-3.

136. A replication deficient oncolytic viral vector or replication competent oncolytic virus according to any one of paragraphs 115 to 135, wherein the cytokine is GITR ligand.

137. A replication deficient oncolytic viral vector or replication competent oncolytic virus according to any one of paragraphs 115 to 136, wherein the cytokine is EDA-A.

138. A replication deficient oncolytic viral vector or replication competent oncolytic virus according to any one of paragraphs 115 to 137, wherein the cytokine is EDA-A2.

139. A replication deficient oncolytic viral vector or replication competent oncolytic virus according to any one of paragraphs 115 to 138, wherein the cytokine is from the TGF-beta superfamily.

140. A replication deficient oncolytic viral vector or replication competent oncolytic virus according to any one of paragraphs 115 to 139, wherein the cytokine is IL-1.

141. A replication deficient oncolytic viral vector or replication competent oncolytic virus according to any one of paragraphs 115 to 140, wherein the cytokine is IL-8.

142. A replication deficient oncolytic viral vector or replication competent oncolytic virus according to any one of paragraphs 115 to 141, wherein the cytokine is IL-2.

143. A replication deficient oncolytic viral vector or replication competent oncolytic virus according to any one of paragraphs 115 to 142, wherein the cytokine is IL-10.

144. A replication deficient oncolytic viral vector or replication competent oncolytic virus according to any one of paragraphs 115 to 143, wherein the cytokine is IL-17.

145. A replication deficient oncolytic viral vector or replication competent oncolytic virus according to any one of paragraphs 115 to 144, wherein the cytokine is from the interferon family.

146. A replication deficient oncolytic viral vector or replication competent oncolytic virus according to any one of paragraphs 114 or 115 wherein the encoded cytokine is independently selected from TNF-alpha, IL-1, IL-8, IL-10, IL-17, interferon, LIGHT, TL1A, Siva, TRAIL, RANKL, TWEAK, APRIL, NGF, BDNF, NT-3, and EDA-A2.

147. A replication deficient oncolytic viral vector or replication competent oncolytic virus according to any one of paragraphs 114, 115 or 146 wherein the encoded cytokine is independently selected from TNF-C, OX40L, CD154, FasL, CD70, CD153, 4-1BB ligand, and EDA-A.

148. A replication deficient oncolytic viral vector or replication competent oncolytic virus according to any one of paragraph 18 to 147, wherein the cytokine is selected from the group comprising IL-2, IFN-alpha, IFN-beta, IFN-gamma, Flt3 ligand, GM-CSF, IL-15, and IL-12.

149. A replication deficient oncolytic viral vector or replication competent oncolytic virus according to paragraph 148, wherein the cytokine is IL-2.

150. A replication deficient oncolytic viral vector or replication competent oncolytic virus according to paragraph 148 or 149, wherein the cytokine is IFN-alpha.

151. A replication deficient oncolytic viral vector or replication competent oncolytic virus according to any one of paragraphs 148 to 150, wherein the cytokine is IFN-beta.

152. A replication deficient oncolytic viral vector or replication competent oncolytic virus according to any one of paragraphs 148 to 151, wherein the cytokine is IFN-gamma.

153. A replication deficient oncolytic viral vector or replication competent oncolytic virus according to any one of paragraphs 148 to 152, wherein the cytokine is Flt3 ligand.

154. A replication deficient oncolytic viral vector or replication competent oncolytic virus according to any one of paragraphs 148 to 153, wherein the cytokine is GM-CSF.

155. A replication deficient oncolytic viral vector or replication competent oncolytic virus according to any one of paragraphs 148 to 154, wherein the cytokine is IL-15.

156. A replication deficient oncolytic viral vector or replication competent oncolytic virus according to any one of paragraphs 148 to 154, wherein the cytokine is IL-12.

157. A replication deficient oncolytic viral vector or replication competent oncolytic virus according to any one of paragraph 21 to 156, wherein at least one further transgene encodes a chemokine.

158. A replication deficient oncolytic viral vector or replication competent oncolytic virus according to any one of paragraph 21 to 34, wherein the chemokine is selected from the group comprising MIP-1 alpha, RANTES, IL-8, CCL5, CCL17, CCL20, CCL22, CXCL9, CXCL10, CXCL11, CXCL13, CXCL12, CCL2, CCL19 and CCL21.

159. A replication deficient oncolytic viral vector or replication competent oncolytic virus according to paragraph 158, wherein the chemokine encoded is MIP-1 alpha.

160. A replication deficient oncolytic viral vector or replication competent oncolytic virus according to paragraph 158 or 159, wherein the chemokine encoded is RANTES.

161. A replication deficient oncolytic viral vector or replication competent oncolytic virus according to any one of paragraphs 158 to 160, wherein the chemokine encoded is IL-8.

162. A replication deficient oncolytic viral vector or replication competent oncolytic virus according to any one of paragraphs 158 to 161, wherein the chemokine encoded is CCL5.

163. A replication deficient oncolytic viral vector or replication competent oncolytic virus according to any one of paragraphs 158 to 162, wherein the chemokine encoded is CCL17.

164. A replication deficient oncolytic viral vector or replication competent oncolytic virus according to any one of paragraphs 158 to 163, wherein the chemokine encoded is CCL20.

165. A replication deficient oncolytic viral vector or replication competent oncolytic virus according to any one of paragraphs 158 to 164, wherein the chemokine encoded is CCL22.

166. A replication deficient oncolytic viral vector or replication competent oncolytic virus according to any one of paragraphs 158 to 165, wherein the chemokine encoded is CXCL9.

167. A replication deficient oncolytic viral vector or replication competent oncolytic virus according to any one of paragraphs 158 to 166, wherein the chemokine encoded is CXCL10.

168. A replication deficient oncolytic viral vector or replication competent oncolytic virus according to any one of paragraphs 158 to 167, wherein the chemokine encoded is CXCL11.

169. A replication deficient oncolytic viral vector or replication competent oncolytic virus according to any one of paragraphs 158 to 168, wherein the chemokine encoded is CXCL12.

170. A replication deficient oncolytic viral vector or replication competent oncolytic virus according to any one of paragraphs 158 to 169, wherein the chemokine encoded is CXCL13.

171. A replication deficient oncolytic viral vector or replication competent oncolytic virus according to any one of paragraphs 158 to 170, wherein the chemokine encoded is CCL2.

172. A replication deficient oncolytic viral vector or replication competent oncolytic virus according to any one of paragraphs 158 to 171, wherein the chemokine encoded is CCL19.

173. A replication deficient oncolytic viral vector or replication competent oncolytic virus according to any one of paragraphs 158 to 172, wherein the chemokine encoded is CCL21.

174. A replication deficient oncolytic viral vector or replication competent oncolytic virus according to paragraph 159, wherein the virus comprises transgenes encoding a cytokine and chemokine combination selected from i) MIP-1α and Flt3, and ii) MIP-1α and IFNα.

175. A replication deficient oncolytic viral vector or replication competent oncolytic virus according to any one of claims 1 to 174, wherein the anti-CD3 antibody or binding fragment has at least the binding domain comprising a VH and a VL regions from muromonab-CD3 (OKT3), otelixizumab, teplizumab or visilizumab.

176. A method of treating a cancer patient by in vivo stimulation of T cells, for example T cells in the cancer cell environment, to focus on cancerous cells by:

administering a therapeutically effective amount of a replication deficient oncolytic viral vector or oncolytic replication capable virus encoding an antibody or a binding fragment thereof to the antigen-specific T-cell receptor complex (TCR), wherein the virus or viral vector selectively infects said cancerous cells and expresses on the surface of the cell the said encoded anti-TCR antibody or binding fragment.

177. A method of treating a cancer patient according to paragraph 176 by:

administering a therapeutically effective amount of a replication deficient oncolytic viral vector or oncolytic replication capable virus encoding an anti-CD3 antibody or a binding fragment thereof, wherein the virus or viral vector selectively infects said cancerous cells and expresses on the surface of the cell the said encoded anti-CD3 antibody or binding fragment.

178. A method of treating a cancer patient comprising administering a therapeutically effective amount of a replication deficient oncolytic viral vector or oncolytic replication capable virus encoding an anti-TCR antibody or binding fragment thereof (such as anti-CD3 antibody or a binding fragment thereof), for expression on the surface of a cancer cell.

179. A method according to any one of paragraph 176 to 178, wherein the virus is replication competent.

180. A method according to any one of paragraph 176 to 178, wherein the virus is replication deficient.

181. A method according to any one of paragraphs 176 to 180, wherein the oncolytic virus or viral vector is selected from an adenovirus (such as Ad5, Ad3, Ad11, Ad35, Ad11/Ad3 and Ad5/3 based viruses), herpes simplex virus (such as HSV-1), reovirus, vaccina virus, Seneca valley virus, coxsackie virus, measles virus, Maraba virus and Newcastle disease virus.

182. A method according to paragraph 181, wherein the virus or viral vector is selected from the group comprising Oncorine (H101), Talimogene laparepvec, Reolysin, Pexastimogene devacirepvec (JX-594), Cavatak, Seprehvir, CGTG-102, MV-NIS, PV701, CL-ONC1, CG0070, and enadenotucirev (EnAd).

183. A method according to paragraph 181, wherein the oncolytic virus or viral vector is an adenovirus.

184. A method according to paragraph 183, wherein the oncolytic virus or viral vector is a group B virus, for example Ad11 or a derivative thereof.

185. A method according to paragraph 184, wherein the oncolytic virus or viral vector is enadenotucirev.

186. A method according to any one of paragraph 176 to 185, wherein the antibody or binding fragment is selected from the group comprising a full length antibody, a Fab, modified Fab, Fab', modified Fab', F(ab')2, Fv, single domain antibodies, scFv, bi, tri or tetra-valent antibodies, bis-scFv, diabodies, triabodies, tetrabodies, humabodies, disulfide stabilised forms of any one of the same and epitope-binding fragments thereof.

187. A method according to paragraph 186, wherein the antibody binding fragment is a single chain Fv.

188. A method according to any one of paragraph 176 to 187, wherein the oncolytic virus or viral vector encodes a further transgene.

189. A method according to paragraph 188, wherein the further transgene encodes a protein independently selected from the group comprising a cytokine, a chemokine, an antagonistic antibody molecule or fragment thereof, an agonistic antibody molecule or fragment thereof and combinations thereof.

190. A method according to paragraph 189, wherein the cytokine is selected from the group comprising IL-2, IFN-alpha, IFN-beta, IFN-gamma, Flt3 ligand, GM-CSF, IL-15, IL-12 and combinations thereof.

191. A method according to paragraph 189 or 190, wherein the chemokine is selected from the group comprising MIP-1 alpha, RANTES, IL-8, CCL5, CCL17, CCL20, CCL22, CXCL9, CXCL10, CXCL11, CXCL13, CXCL12, CCL2, CCL19, CCL21 and combinations thereof.

192. A method according to any one of paragraph 189 to 191, wherein a cytokine and chemokine combination of MIP-1α and Flt3 or MIP-1α and IFNα is encoded in the virus.

193. A method according to any one of claims 176 to 192, wherein the anti-CD3 antibody or binding fragment has at least the binding domain comprising a VH and a VL regions from muromonab-CD3 (OKT3), otelixizumab, teplizumab or visilizumab.

194. A method according any one of paragraph 176 to 193, wherein the anti-CD3 antibody or binding fragment thereof comprises a transmembrane domain or a GPI anchor.

195. A method according to paragraph 194, wherein the transmembrane is selected from a sequence shown in SEQ ID NO: 10 to 14.

196. A method according to any one of paragraph 176 to 195, where a linker sequence is employed between the transmembrane domain and the antibody or binding antibody fragment, such as scFv (e.g. myc tag sequence, CD80, CD86 membrane proximal sequences, immunoglobulin sequences).

In one embodiment one or more transgene encoded by the virus of the present disclosure are under the control of an endogenous promoter, in particular where the virus is an adenovirus.

In one embodiment one or more transgene encoded by the virus of the present disclosure are under the control of an exogenous promoter such as a CMV promoter, in particular where the virus is a non-adenovirus.

In one embodiment there is provided a virus (replication deficient or replication competent virus comprising a transgene cassette disclosed here, including disclosed as part of complete virus sequence).

In one embodiment an adenovirus of the present disclosure does not encode a B7 protein nor does it express an active fragment thereof.

In one embodiment a protein or peptide encoded by a virus of the present disclosure for surface expression on a cancer cell is an immunogenic protein, for example a non-human protein.

In a one aspect the present disclosure provides a method of treating a cancer patient by stimulating in vivo T cells to focus on cancerous cells by administering a therapeutically effective amount of a replication deficient oncolytic viral vector or replication competent oncolytic virus encoding an anti-TCR antibody or a binding fragment thereof (such as an anti-CD3 antibody or binding fragment thereof), for expression on the surface of said cancerous cells.

Thus there is provided a method of treating a cancer patient by in vivo stimulation of T cells, for example T cells in the cancer cell environment, to focus on cancerous cells by: administering a therapeutically effective amount of a replication deficient oncolytic viral vector or oncolytic replication competent virus encoding an anti-TCR antibody or a binding fragment thereof (such as an anti-CD3 antibody or binding fragment thereof), wherein the virus or viral vector selectively infects said cancerous cells and expresses on the surface of the cell the said encoded anti-TCR antibody or binding fragment.

Also provided is a replication deficient oncolytic viral vector or a replication competent oncolytic virus encoding an anti-TCR antibody or a binding fragment thereof (such as an anti-CD3 antibody or binding fragment thereof), for expression on the surface of cancerous cells, for use in treatment of a cancer patient by in vivo stimulation of T cells, in particular T cells in the cancer cell environment, to focus on said cancerous cells. As described herein the virus or viral vector selectively infects said cancerous cells and expresses on the surface of the cell the said encoded anti-TCR antibody or binding fragment (such as an anti-CD3 antibody or binding fragment thereof).

In one embodiment there is provided a replication deficient oncolytic viral vector or a replication competent oncolytic virus encoding a an anti-TCR antibody or a binding fragment thereof, encoding a an anti-TCR antibody or a binding fragment thereof (such as an anti-CD3 antibody or binding fragment thereof), for expression on the surface of cancerous cells for use in the manufacture of a medicament for the treatment cancer by in vivo stimulation of T cells, in particular T cells in the cancer cell environment, to focus on said cancerous cells.

In a second independent embodiment there is provided a method of treating a cancer patient comprising administering a therapeutically effective amount of a replication deficient oncolytic viral vector or oncolytic replication competent virus encoding an anti-TCR antibody or a binding fragment thereof (such as an anti-CD3 antibody or binding fragment thereof), for expression on the surface of a cancer cell, for example with the proviso that when the virus is a replication competent oncolytic adenovirus then: a transgene or transgenes therein are under the control of an exogenous promoter, and/or the virus does not encode a B7 protein or an active fragment thereof.

Thus there is provide a replication deficient oncolytic viral vector or oncolytic replication competent virus encoding an anti-TCR antibody or a binding fragment thereof (such as an anti-CD3 antibody or binding fragment thereof), for expression on the surface of a cancer cell, for use in the treatment of cancer, for example with the proviso that when the virus is a replication competent oncolytic adenovirus then: a transgene or transgenes therein is/are under the control of an exogenous promoter, and/or the virus does not encode a B7 protein or an active fragment thereof.

In one embodiment a replication deficient oncolytic viral vector or oncolytic replication competent virus encoding an anti-TCR antibody or a binding fragment thereof (such as an anti-CD3 antibody or binding fragment thereof), for expression on the surface of a cancer cell, for the manufacture of a medicament for the treatment of cancer, for example with the proviso that when the virus is a replication competent oncolytic adenovirus then: a transgene or transgenes therein are under the control of an exogenous promoter, and/or the virus does not encode a B7 protein or an active fragment thereof.

In an independent aspect there is provided a replication deficient oncolytic viral vector or replication competent oncolytic virus encoding an anti TCR antibody or binding fragment thereof (such as an anti-CD3 antibody or binding fragment thereof) for expression on the surface of a cancer cell.

Thus in a third aspect there is provided a replication deficient oncolytic viral vector or replication competent oncolytic virus encoding an anti-TCR antibody or binding fragment thereof (such as an anti-CD3 antibody or binding fragment thereof) for expression on the surface of a cancer cell, for example with the proviso that when the virus is a replication competent oncolytic adenovirus then: a transgene or transgenes therein are under the control of an exogenous promoter, and/or the virus does not encode a B7 protein or an active fragment thereof.

In one embodiment of the present disclosure the virus is replication competent. In one embodiment the present disclosure is not a replication competent oncolytic adenovirus. In one embodiment of the present disclosure the viral vector, which is replication deficient, for example deleted in part or all of a gene essential for viral replication, for example the E1 region in adenoviruses.

In one embodiment of the disclosure the virus or viral vector is attenuated.

In one embodiment of the disclosure the oncolytic virus or viral vector is selected from an adenovirus (such as Ad5, Ad3, Ad11, Ad11/Ad3 and Ad5/3), herpes simplex virus (such as HSV-1), reovirus, vaccina virus, Seneca valley virus, coxsackie virus, Maraba virus, measles virus, vesicular stomatitis virus and New Castle disease virus, including mutated versions, variants or derivatives thereof comprising a transgene.

In one embodiment the virus or viral vector is selected from the group comprising Oncorine (H101), Talimogene, Reolysin, Pexastimogene devacirepvec (JX-594), Cavatak, Seprehvir, CGTG-102, MV-NIS, PV701, CL-ONC1, CG0070, and Enadenotucirev (EnAd), including mutated versions, variants or derivatives thereof comprising a transgene.

In one embodiment of the disclosure the oncolytic virus is an adenovirus, for example a group B virus, such as Ad11, more specifically EnAd.

In one embodiment of the disclosure the oncolytic virus is not an adenovirus, for example is not a group B adenovirus, such as is not Ad11, more specifically is not EnAd.

In one embodiment the anti-TCR antibody or binding fragment thereof is specific to the TCR alpha, beta, gamma or delta proteins that are directly involved in antigen binding or a combination thereof, for example an anti-TCR beta chain antibody.

In one embodiment the anti-TCR antibody or binding fragment is specific to CD3 delta, epsilon, gamma or a combination thereof, in particular is specific to CD3 epsilon.

In one embodiment the binding domain comprises a VH and a VL from an antibody muromonab-CD3 (also known as OKT3), otelixizumab (also known as TRX4), teplizumab (also known as hOKT3γ1 (Ala-Ala)), or visilizumab.

In one embodiment of the disclosure when the replication competent virus is an adenovirus the binding domain of the agonistic anti-TCR antibody or binding fragment thereof does not comprise a VH and a VL from an antibody muromonab-CD3 (also known as OKT3), otelixizumab (also known as TRX4), teplizumab (also known as hOKT3γ1(Ala-Ala)), or visilizumab.

In one embodiment of the disclosure the oncolytic virus or viral vector encodes a further transgene, for example a further transgene encoding a protein selected from the group comprising a cytokine, a chemokine, an antagonistic antibody molecule or fragment thereof, an agonistic antibody molecule, or fragment thereof, an immunomodulator and combinations thereof.

In one embodiment of the disclosure the oncolytic virus or viral vector encodes at least two further transgenes, for example a further transgene encoding a protein independently selected from the group comprising a cytokine, a chemokine, an antagonistic antibody molecule or fragment thereof, an agonistic antibody molecule, or fragment thereof, an immunomodulator and combinations thereof.

In one embodiment the further transgene encodes an antibody or binding fragment thereof.

An antibody binding fragment which may be encoded by an oncolytic virus or viral vector of the disclosure in one embodiment is independently selected from a Fab, modified Fab, Fab', modified Fab', F(ab')2, Fv, single domain antibodies, scFv, bi, tri or tetra-valent antibodies, Bis-scFv, diabodies, triabodies, tetrabodies, disulfide stabilised forms of any one of the same and epitope-binding fragments thereof, in particular a scFv.

In one embodiment the antibody encoded is a full length antibody.

In one embodiment of the disclosure the further transgene encodes an antibody or binding fragment which activates T cells, for example is agonist which stimulates T cell signalling, such an antibody or binding fragment specific to CD28, in particular an agonist specific to CD28.

In one embodiment of the disclosure, the further transgene encodes a cytokine, for example a secreted or membrane associated cytokine.

Cytokine as employed herein means low-molecular-weight proteins that can regulate the nature, intensity and duration of immune response by binding to specific receptors on target cells and exerting a variety of effects on lymphocytes and/or other cells. As used herein, the term cytokine includes secreted versions of cell surface ligands or receptors, including fusion proteins (for example molecules fused to an immunoglobulin Fc domain).

In one embodiment according to the present disclosure the cytokine encoded is selected from the group comprising IL-2, IFN-alpha, IFN-beta, IFN-gamma, Flt3 ligand, GM-CSF, IL-15, IL-12 and combinations thereof.

In one embodiment according to the present disclosure the encoded cytokine is independently selected from the TNF alpha super family (TNFRSF includes TNF-alpha, TNF-C, OX40L, CD154, FasL, LIGHT, TL1A, CD70, Siva, CD153, 4-1BB ligand, TRAIL, RANKL, TWEAK, APRIL, BAFF, CAMLG, NGF, BDNF, NT-3, NT-4, GITR ligand, EDA-A, EDA-A2), TGF-beta superfamily, IL-1 family (i.e. IL-1 and IL-8), IL-2 family, IL-10 family, IL-17 family, interferon family.

In one embodiment according to the present disclosure the chemokine is selected from the group comprising MIP-1 alpha, IL-8, CCL5, CCL17, CCL20, CCL22, CXCL9, CXCL10, CXCL11, CXCL13, CXCL12, CCL2, CCL19, CCL21 and combinations thereof.

In one embodiment according to the present disclosure the chemokine is selected from the group comprising CXCR2, CCR2, CCR4, CCR5, CCR6, CCR7, CCR8, CXCR3, CXCR4, CXCR5 and CRTH2.

In one embodiment the further transgenes encode a first antibody or binding fragment thereof and a second antibody or binding fragment thereof, referred to herein an antibody/antibody combination.

In one embodiment the further transgene or transgenes encode an antibody or binding fragment and a cytokine, referred to herein as an antibody/cytokine combination.

In one embodiment the further transgene or transgenes encodes a first cytokine and a second cytokine, referred to herein as a cytokine/cytokine combination.

In one embodiment the further transgene or transgenes encode a first chemokine and a second chemokine, referred to herein as a chemokine/chemokine combination.

In one embodiment the further transgene or transgenes encode a chemokine and cytokine, referred to herein as cytokine/chemokine combination.

Where there are multiple transgenes one will generally encode one entity such as the cytokine or antibody etc. and a different gene will encode the entity, for example the chemokine or antibody etc.

Thus in one embodiment according to the present disclosure the oncolytic virus or viral vector encodes a cytokine, chemokine combination, for example MIP-1α and Flt3 or MIP-1α and IFNα.

In one embodiment the anti-TCR antibody or binding fragment has at least the binding domain comprising a VH and a VL regions from muromonab-CD3 (OKT3) the variable regions for which are shown in SEQ ID NO: 1 and 2 and a single chain Fv version of which is shown in SEQ ID NO: 3, otelixizumab, teplizumab (the variable regions for which are shown in SEQ ID NO: 6 and 7) or visilizumab.

In one embodiment a transgene encoded by the virus, for example the anti-TCR antibody or binding fragment thereof (such as an anti-CD3 antibody or binding fragment thereof) comprises a transmembrane domain or a GPI anchor.

In one embodiment the anti-CD3 antibody or binding fragment is only surface expressed, that it is not expressed as a secreted protein.

In one embodiment a combination of a transmembrane domain and a secretory signal sequence is employed to express a protein encoded by the virus (for example as described herein) on the surface of an infected cancer cell. The present inventors have shown that the proteins encoded are expressed only on cells which are permissive to infection by the virus, i.e. cancer cells.

In one embodiment the fragment employed to express the protein on the surface of the infected cancer cell (such as the transmembrane fragment) is selected from the group comprising TM Domain Sequences (Minimal portions) given in SEQ ID NO: 10, 11, 12, 13 or 14:

| SEQ ID NO: | Name | SEQUENCE |
|---|---|---|
| 10 | PDGFR Receptor A | AVLVLLVIVIISLIVLVVIW |
| 11 | PDGFR Receptor B | VVISAILALVVLTIISLIILI |
| 12 | INSULIN-LIKE GROWTH FACTOR 1 | IIIGPPLIFVFLFSVVIGSIYLFL |
| 13 | IL6-R | SSSVPLPTFLVAGGSLAFGTLLCIAIVL |
| 14 | CD28 | FWVLVVVGGVLACYSLLVTVAFIIFWV |

In one embodiment the transmembrane domain is from a B7 protein.

In one embodiment the oncolytic virus or viral vector according to the present disclosure, in particular a replication competent adenovirus, such as Ad11 or EnAd does not encode a B7 protein nor an active fragment thereof.

In one embodiment the treatment is by in vivo stimulation of T cells, for example T cells in the cancer cell environment, to focus on cancerous cell.

SUMMARY OF THE FIGURES

FIG. 3 shows schematics of the NG-348A (FIG. 3A), NG-420 (FIG. 3B) and NG-420A (FIG. 3C) transgene cassettes FIG. 7 shows CD25 is upregulated on human CD3$^+$ T-cells following co-culture with NG-348 infected A549 cells, but not when infection was with EnAd (FIG. 7A), with both the percentage of CD25+ cells (FIG. 7B) and the level of CD25 expression per cell (FIG. 7C) was increased.

FIG. 12 shows induction of IL-2 (FIG. 12A) and IFNγ (FIG. 12B) production by CD3$^+$ T cells following co-culture with NG-348 infected A549 cells, but no IL-2 and only low levels of IFNγ when infection was with EnAd.

FIG. 13 shows induction of IFNγ production by both CD4$^+$ (FIG. 13A) and CD8$^+$ (FIG. 13B) CD3$^+$ T cells following co-culture with NG-348 infected A549 cells, but no (CD4$^+$ cells) or low (CD8$^+$ cells) IFNγ when infection was with EnAd.

FIG. 21 shows IFNα and MIP1α transgene mRNA generated by virus NG-347 in T cells compared to A549 tumour cells

FIG. 44 shows the signalling pathway of the TNF superfamily, from a Nature Reviews Immunology 3, 745-756 (September 2003).

FIG. 45 shows a schematic of the recombinant HSV-1virus, deleted for ICP-34.5 and with a transgene (labelled as X) incorporated FIGS. 46 A-E shows transgene expression and T cell activation by HSV-X. Expression of the GFP reporter and of CD80 was evaluated by Flow cytometry, measuring the geometric mean fluorescence intensity and the percentage of positive cells, for each parameter. Expression of CD80 was only observed only in cells infected with HSV-X-8.1.

FIGS. 47 A-I show the evaluation of transgene expression in tumour target cells by flow cytometry analysis of CD69 expression. All 8 subclones were able to induce activation of T-cells as assessed by CD69 upregulation in tumour cells.

FIG. 52C-D shows expression of the GFP reporter gene evaluated by flow cytometry at two different concentrations (1:10 and 1:100). GFP was expressed only by the recombinant viruses WR-434 and Wy-434.

FIG. 52E-F shows both recombinant viruses were also able to express CD80, unlike the wild type control viruses.

FIG. 58C shows detection of IFNγ expression, co-culture supernatants were diluted into 5% BSA/PBS assay buffer (in a range of 1:20 to 1:50) and ELISA was carried out using the human IFNγ Quantikine kit (R and D systems). The concentration of secreted IFNγ was determined by interpolating from the standard curve.

FIG. 58D shows IFNγ expression assayed by ELISA from co-cultures of HSV and vaccinia virus infected HT-29 cells with T cells, described in examples 2 and 4. ELISA was carried out using the human IFNγ Quantikine kit (R and D systems).

FIG. 59-72 shows various amino acid and polynucleotide sequence.

SUMMARY OF THE SEQUENCE LISTING

Figure 1:
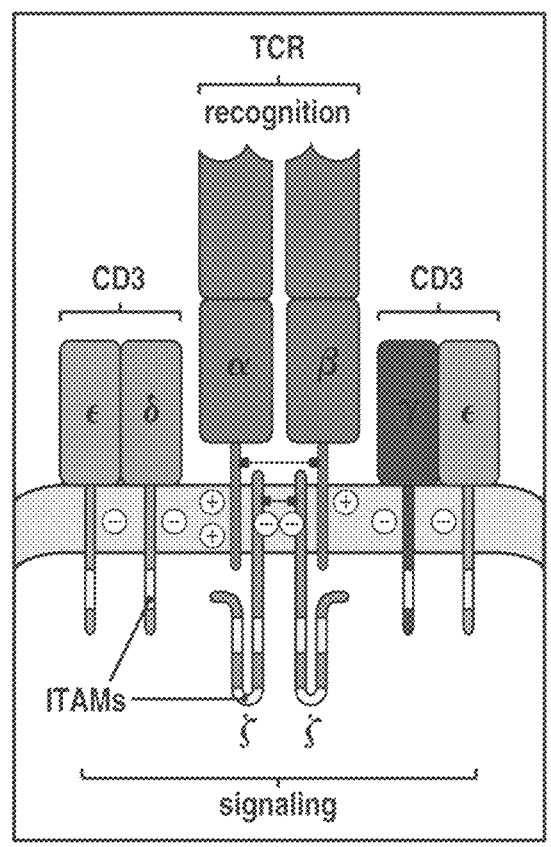
FIG. 1 shows a representation of a T cell receptor (example with alpha-beta antigen recognition chains)

The present application contains 127 sequences in the associated sequence listing.

SEQ ID NO: 1 Amino acid sequence of the VH region of the antibody OKT3.

SEQ ID NO: 2 Amino acid sequence of the VH region of the antibody OKT3.

SEQ ID NO: 3 Amino acid sequence of the scFv construct contain OKT3 VH and VL.

SEQ ID NO: 4 Amino acid sequence of membrane anchored version of the scFv of SEQ ID NO: 3

SEQ ID NO: 5 Amino acid sequence of SEQ ID NO: 4, with V5 tag.

SEQ ID NO: 6 Amino acid sequence of teplizumab VH.

SEQ ID NO: 7 Amino acid sequence of teplizumab VL.

SEQ ID NO: 8 Amino acid sequence of teplizumab heavy chain.

SEQ ID NO: 9 Amino acid sequence of teplizumab light chain.

SEQ ID NO: 10 Amino acid sequence of PDGFR Receptor A.

SEQ ID NO: 11 Amino acid sequence of PDGFR Receptor B.

SEQ ID NO: 12 Amino acid sequence of Insulin-Like growth factor 1.

SEQ ID NO: 13 Amino acid sequence of IL-6R.

SEQ ID NO: 14 Amino acid sequence of CD28.

SEQ ID NO: 15 Amino acid sequence of PDGFR TM Domain.

SEQ ID NO: 16 Amino acid sequence of c-myc tag.

SEQ ID NO: 17 Amino acid sequence of c-myc tag with spacers.

SEQ ID NO: 18 Amino acid sequence of PDGFR TM Domain with N-terminal c-myc tag.

SEQ ID NO: 19 Amino acid sequence of HuVH human VH leader sequence

SEQ ID NO: 20 Amino acid sequence of a linker.

SEQ ID NO: 21 Polynucleotide sequence of EnAd Genome

SEQ ID NO: 22 to 30 Amino acid sequence of hinge linker sequence.

SEQ ID NO: 31 to 70 Amino acid sequence of a flexible linker sequence.

SEQ ID NO: 71 to 86 Amino acid sequence of a linker sequence.

SEQ ID NO: 87 Polynucleotide sequence of E2B region of the EnAd GENOME (BP 10355-5068).

SEQ ID NO: 88 Polynucleotide sequence of a non-coding sequence suitable for inclusion into BX.

SEQ ID NO: 89 Polynucleotide sequence of a non-coding sequence suitable for inclusion into BY.

SEQ ID NO: 90 & 91 Polynucleotide sequence of a splice acceptor sequence.

SEQ ID NO: 92 Polynucleotide sequence comprising a start codon.

SEQ ID NO: 93 Polynucleotide sequence of IRES.

SEQ ID NO: 94 Amino acid sequence of high efficiency self-cleavable P2A peptide sequence.

SEQ ID NO: 95 Amino acid sequence of high efficiency self-cleavable F2A peptide sequence.

SEQ ID NO: 96 Amino acid sequence of high efficiency self-cleavable E2A peptide sequence.

SEQ ID NO: 97 Amino acid sequence of high efficiency self-cleavable T2A peptide sequence.

SEQ ID NO: 98 Amino acid sequence of human CD80 amino acid sequence.

SEQ ID NO: 99 Polynucleotide sequence of a polyadenylation sequence (5V40 late polyA sequence).

SEQ ID NO: 100 Polynucleotide of NG-348 virus genome sequence.

SEQ ID NO: 101 Amino acid of V5 TAG

SEQ ID NO: 102 Polynucleotide of NG-348A virus genome sequence.

SEQ ID NO: 103 Polynucleotide of NG-420 virus genome sequence.

SEQ ID NO: 104 Polynucleotide of NG-420A virus genome sequence.

SEQ ID NO: 105 Polynucleotide of NG-444-R in pUC57-Kan plasmid.

SEQ ID NO: 106 Polynucleotide of 434-MVA-GFP+ transgene.

SEQ ID NO: 107 Polynucleotide of 1863-MVA-GFP+ transgene.

SEQ ID NO: 108 Polynucleotide 1864-MVA-GFP+transgene.

SEQ ID NO: 109 Polynucleotide CMV promoter.

SEQ ID NO: 110 Polynucleotide Ad5-348 genome.

SEQ ID NO: 111 Amino acid sequence human interferon-a amino acid sequence.

SEQ ID NO: 112 Amino acid sequence human soluble Flt3 ligand amino acid sequence.

SEQ ID NO: 113 Amino acid sequence human macrophage inflammatory protein 1a amino acid sequence (LD78b isoform).

SEQ ID NO: 114 Amino acid sequence membrane anchored form of the anti-human CD3 single chain Fv.

SEQ ID NO: 115 Polynucleotide sequence of NG-330 virus genome.

SEQ ID NO: 116 Polynucleotide sequence of NG-343 virus genome.

SEQ ID NO: 117 Polynucleotide sequence of NG-345 virus genome.

SEQ ID NO: 118 Polynucleotide sequence of NG-346 virus genome.

SEQ ID NO: 119 Polynucleotide sequence of NG-347 virus genome.

SEQ ID NO: 120 Polynucleotide of E3 region from EnAd.

SEQ ID NO: 121 Polynucleotide of a non-coding sequence suitable for inclusion into BY.

SEQ ID NO: 122 Polynucleotide sequence of NG-348 virus genome.

SEQ ID NO: 123 Polynucleotide sequence of membrane tethered OKT3-scFv.

SEQ ID NO: 124 Polynucleotide sequence of transgene cassette from NG-348.

SEQ ID NO: 125 Polynucleotide sequence of fully synthetic EnAd genome with incorporated cloning site for transgene cassette insertion as in plasmid pEnAd2.4

SEQ ID NO: 126 Polynucleotide sequence encoding human CD80.

SEQ ID NO: 127 Polynucleotide sequence encoding transmembrane from of anti-CD3 scFv.

DETAILED DISCLOSURE

T cells in the cancer environment include T cells inside a tumor and T cells in the vicinity of the tumor, for example T cells outside the tumor but able to engage the tumor or cancerous cell, in particular physically engage the tumor or cancerous cell.

There is evidence to suggest that the T cell infiltrate into tumors and once inside they are deactivated. Advantageously the method of the present disclosure is capable of activating T cells inside the tumor. In one embodiment the T cells inside the tumor are activated by oncolytic virus or viral vector according to the present disclosure.

In one embodiment a transmembrane tether or anchor sequence employed in the present disclosure comprises a PDGFR TM domain (e.g.ala513-arg561), such as shown in the sequence of SEQ ID NO: 15.

The transmembrane domains employed herein may be advantages in relation how the protein is expressed and/or in that the properties of the cell membrane after the expression of the protein thereon are not adversely affected.

In one embodiment a tether or anchor sequence employed in the present disclosure comprises a tag attached to a PDGF receptor or fragment thereof, such as PDGFR TM domain. Suitable tags include His-tags, Flag-tags, c-myc tag and the like. More specifically the tether or anchor may comprise a c-myc tag for example of SEQ ID NO: 16 EQKLISEEDL followed by a PDGFR TM domain is employed, for ala513-arg561), such as shown in the sequence of SEQ ID NO: 15

In one embodiment the c-myc tag comprises a spacer or spacer amino acids at the 3' and/or 5' end, for example as shown in the sequence of SEQ ID NO: 17 gsEQKLISEEDLn.

In one embodiment the tether or anchor sequence employed is shown in the sequence of SEQ ID NO: 18.

Generally the protein/polypeptide to which the tether or anchor is attached does not comprise a stop codon.

In one embodiment the leader sequence for the protein to be expressed on the cancer cell surface is human, for example the human VH leader sequence (HuVH) (SEQ ID NO. 19).

In one embodiment the structure of the ORF cassette is as follows:

LS-POLY-TAG-TM_D wherein
LS is a leader sequence, for example a human leader sequence;
POLY is a polynucleotide encoding polypeptide or proteins of interest, in particular one disclosed herein;
TAG is a tag for example one disclosed herein, such as c-myc, in particular as described herein;
TM_D is a TM domain for example a PDGFR TM domain, also described herein.
When the polypeptide is a scFv then the ORF may be as follows:

LS-VAR$_1$-LINK-VAR$_2$-TAG-TM_D wherein
LS is a leader sequence, for example a human leader sequence;
VAR$_1$ is a polynucleotide encoding a variable region such as VH region;
LINK is a linker, for example as disclosed herein, such as a linker based on the units of G$_4$S, in particular the sequence of SEQ ID NO: 20 GGGGSGGGGSGGGGS;
VAR$_2$ is a polynucleotide encoding a variable region, such as a VL region;
TAG is a tag, for example one disclosed herein, such as c-myc, in particular a sequence described herein;
TM_D is a TM domain for example a PDGFR TM domain, for example a sequence described herein.

The disclosure also extends to embodiments, in particular those described specifically herein, which comprise a tag at the N- or C-termini of the polypeptide chains, such that it resides inside or on the outside of the membrane. Thus a C-termini tag located inside the membrane is advantageous because it is not likely to interfere with the binding or function of the polypeptide.

Alternative methods to employing transmembrane domains for expressing proteins on the surface of the infected cancer cell include approaches employing glycophospholipid anchor (also referred to as a GPI anchor) attached to the C-terminal amino acid of the extracellular protein or fragment (Low et al 1986, Cross 1987, Low and Saltiel 1988, Ferguson and William 1988). Known glycophospholipid anchors include those from Thy-1, N-CAM and DAF.

In one embodiment a combination of a transmembrane domain and a secretory signal sequence is employed to express a protein encoded by the virus (for example as described herein) on the surface of an infected cancer cell. The present inventors have shown that the proteins encoded are expressed only on cells which are permissive to infection by the oncolytic virus, i.e. cancer cells.

In one embodiment the fragment employed to express the protein on the surface of the infected cancer cell (such as the transmembrane fragment) is selected from the group comprising TM Domain Sequences (Minimal portions) given in SEQ ID NO: 10 to 14.

In one embodiment a transmembrane domain from CD80 or CD86 is employed to express the protein on the surface the cancer cell.

In one embodiment the fragment employed to express the protein on the surface of the infected cancer cell (such as the transmembrane fragment) is selected from about 20 to 25 hydrophobic amino acids which form a transmembrane alpha helix, for example from the proteins including PDGF receptor, insulin-like growth factor receptor, IL-6 receptor, CD28, glycophorin, LDL receptor, influenza HA protein, insulin receptor, Asialoglycoprotein receptor, Transferrin receptor.

In one embodiment the transmembrane domain employed is derived from a G protein-coupled receptor or S antigen from hepatitis B.

In one embodiment a fusion protein comprising a full length extracellular domain of a B7 protein or fragment and also a transmembrane domain derived from a protein other than B7 is arranged such that the B7 protein is located at the terminal end of the fusion protein distal from the cancer cell surface, that is on the outside of the cancer cell facing the extracellular space.

Having the DNA sequence encoding B7 or an active fragment under the control of an endogenous promoter is also advantageous because the protein is expressed in accordance with the virus life cycle as opposed to being constitutively expressed. In the present situation continuous expression under an exogenous promoter, for example a strong promoter like the CMV promoter, may produce more B7 protein than is necessary for a therapeutic effect and result in off-target effects.

In one embodiment oncolytic virus according to present disclosure is an adenovirus, for example a group B adenovirus. In one embodiment the virus according to the present disclosure is a chimeric virus, for example EnAd. In one embodiment the adenovirus is replication competent.

In one embodiment the oncolytic virus is replication capable, for example replication competent.

Replication capable as employed herein is a virus that can replicate in a host cell. In one embodiment replication capable encompasses replication competent and replication selective viruses.

Replication competent as employed herein is intended to mean an oncolytic virus that is capable of replicating in a human cell, such as a cancer cell, without any additional complementation to that required by wild-type viruses, for example without relying on defective cellular machinery.

Replication selective or selective replication as employed herein is intended to mean an oncolytic virus that is able to replicate in cancer cells employing an element which is specific to said cancer cells or upregulated therein, for example defective cellular machinery, such as a p53 mutation, thereby allowing a degree of selectivity over healthy/normal cells.

A "replication capable oncolytic virus" is a replication capable virus which preferentially infects cancer cells. That is, they are tumour selective by infecting tumour cells in preference to non-tumour cells. EnAd is an example of a replication competent virus.

In one embodiment the virus is replication deficient and provided as a viral vector. Viral vectors require a packaging cell or helper to provide a complementary gene to allow replication.

Replication deficient oncolytic viral vector as employed herein refers a replication deficient virus which preferentially infects cancer cells. That is, they are tumour selective by infecting tumour cells in preference to non-tumour cells, for example the viral vector is derived from a replication competent oncolytic virus by deleting a gene essential for replication.

In one embodiment replication deficient oncolytic viral vectors according to the present disclosure In one embodiment the gene encoding the anti-TCR antibody or binding fragment thereof (such as an anti-CD3 antibody or binding fragment thereof) is located between the stop codon and polyA recognition site of the adenoviral gene L5 and the stop codon and polyA recognition site of the gene E4.

In one embodiment gene encoding the anti-TCR antibody or binding fragment thereof (such as an anti-CD3 antibody or binding fragment thereof) is located between about bp 29356 and about 29357 of the EnAd genome, for example as shown in SEQ ID NO: 21, or a position equivalent thereto. The skilled person will understand that the absolute numerical value of the location can change based on how the numbering is allocated.

The CD3 antibody component facilitates in vivo stimulation of T cells, for example T cells in the cancer cell environment, to focus on cancerous cells.

Immunomodulator as employed herein means a modulator of immune response. Immunomodulators function in adjustment of the immune response to a desired level, as in immunopotentiation, immunosuppression, or induction of immunologic tolerance.

In one embodiment the immunomodulator is an antibody or binding fragment (in particular an inhibitor antibody or binding fragment) specific to a target selected from the group comprising CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2.

In one embodiment the immunomodulator is an antibody or binding fragment (in particular an inhibitor antibody or binding fragment) specific to a target selected from the group comprising CD16, CD25, CD33, CD332, CD127, CD31, CD43, CD44, CD162, CD301a, CD301b and Galectin-3.

In one embodiment the immunomodulator is an antibody or binding fragment specific to a target selected from the group comprising: FLT-3, FLT-3 ligand, TLRs, TLR ligands, CCR7, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILT5, ILT7, TSLP Receptor, CD141, CD303, CADM1, CLEC9a, XCR1 and CD304.

In one embodiment the immunomodulator is an antibody or binding fragment specific to a target selected from the group comprising OX40, OX40 ligand, CD27, CD28, CD30, CD40, CD40 ligand, CD70, CD137, GITR, 4-1BB, ICOS and ICOS ligand, for example CD40 and CD40 ligand.

In one embodiment the immunomodulator is a membrane-associated protein ligand for immune cell surface receptors selected from the group comprising CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2.

In one embodiment the immunomodulator is a membrane-associated protein ligand for immune cell surface receptors selected from the group comprising CD16, CD25, CD33, CD332, CD127, CD31, CD43, CD44, CD162, CD301a, CD301b and Galectin-3.

In one embodiment the immunomodulator is a membrane-associated protein ligand for immune cell surface receptors selected from the group comprising: FLT-3, FLT-3 ligand, TLRs, TLR ligands, CCR7, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILI'S, ILT7, TSLP Receptor, CD141, CD303, CADM1, CLEC9a, XCR1 and CD304.

In one embodiment the immunomodulator is a membrane-associated protein ligand for immune cell surface selected from the group comprising OX40, OX40 ligand, CD27, CD28, CD30, CD40, CD40 ligand, CD70, CD137, GITR, 4-1BB, ICOS and ICOS ligand, for example CD40 and CD40 ligand.

In one embodiment the immunomodulator is an antibody or binding fragment specific to a target selected from the group comprising IL-1α, IL-1β, IL-6, IL-9, IL-12, IL-13, IL-17, IL-18, IL-22, IL-23, IL-24, IL-25, IL-26, IL-27, IL-33, IL-35, interleukin-2 (IL-2), IL-4, IL-5, IL-7, IL-10, IL-15, IL-21, IL-25, IL-1RA, IFNα, IFNβ, IFNγ, TNFα, TGFβ, lymphotoxin α (LTA) and GM-CSF.

In one embodiment the oncolytic adenovirus according to the present disclosure has a formula (I):

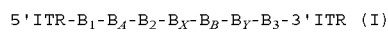

$$5'\text{ITR-}B_1\text{-}B_A\text{-}B_2\text{-}B_X\text{-}B_B\text{-}B_Y\text{-}B_3\text{-}3'\text{ITR} \quad (I)$$

wherein:
$B_1$ is a bond or comprises: E1A, E1B or E1A-E1B;
$B_A$ is E2B-L1-L2-L3-E2A-L4;
$B_2$ is a bond or comprises E3 or a transgene, for example under an endogenous or exogenous promoter;
$B_X$ is a bond or a DNA sequence comprising: a restriction site, one or more transgenes or both;
$B_B$ comprises L5;
$B_Y$ comprises a transgene encoding a B7 protein or an active fragment thereof; and
$B_3$ is a bond or comprises E4.

In one embodiment the oncolytic virus has a formula (Ia):

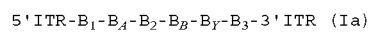

$$5'\text{ITR-}B_1\text{-}B_A\text{-}B_2\text{-}B_B\text{-}B_Y\text{-}B_3\text{-}3'\text{ITR} \quad (Ia)$$

wherein:
$B_1$ is a bond or comprises: E1A, E1B or E1A-E1B;
$B_A$ is E2B-L1-L2-L3-E2A-L4;
$B_2$ is a bond or comprises E3;
$B_B$ comprises L5;
$B_Y$ comprises a transgene encoding a B7 protein or an active fragment thereof; and
$B_3$ is a bond or comprises E4.

In one embodiment the virus genome in constructs of formula (I) and/or (Ia) is from Ad11 or EnAd, in particular EnAd.

In one embodiment the transgene encoding the anti-TCR antibody or binding fragment thereof (such as an anti-CD3 antibody or binding fragment thereof), is under the control of an endogenous promoter, for example the major late promoter.

In one embodiment $B_Y$ comprises a transgene cassette, said cassette comprising a transgene encoding a B7 protein or fragment thereof and a regulatory element, such as combination of regulatory elements.

In one embodiment the regulatory element is splice acceptor sequence.

In one embodiment the regulatory element is a Kozak sequence.

In one embodiment, for example where the transgene encodes a polycistronic RNA molecule, the regulatory element is an IRES sequence.

In one embodiment the regulatory sequence is a high efficiency self-cleavable peptide sequence such as P2A, T2A, F2A, E2A.

In one embodiment the regulatory sequence is a polyA tail.

In one embodiment there are at least two regulatory sequences, for example a splice acceptor and a Kozak sequence or a splice acceptor and a polyA tail, or a splice acceptor and an IRES sequence, or a splice acceptor and a P2A sequence.

In one embodiment there are at least three regulator sequences, for example a splice acceptor sequence, a Kozak sequence and polyA tail, or a splice acceptor sequence an IRES or 2A sequence and a polyA tail; or a splice acceptor sequence, Kozak sequence and an IRES or 2A sequence.

In one embodiment there are at least four regulatory sequences, for example a splice acceptor sequence, a Kozak sequence, an IRES or 2A sequence and a polyA tail, in particular from L5 to E4 in the order splice acceptor sequence, Kozak sequence, IRES or 2A sequence and a polyA tail.

In on embodiment the transgene encodes a polycistronic RNA molecule comprising both an IRES and a 2A regulatory sequence In one embodiment a non-adenovirus encodes a B7 protein is independently selected from B7-1, B7-2, B7-DC, B7-H1, B7-H2, B7-H3, B7-H4, B7-H5, B7-H6, B7-H7, active fragments of the same, and combinations thereof. In one embodiment the B7 protein is B7-1 (CD80), B7-2 (CD86) or an active fragment of any of the same and combinations thereof, in particular B7-1 or an active fragment thereof.

In one embodiment the B7 fragment comprises or consists of a transmembrane domain from a B7 protein in particular one described herein, such as B7-1. This domain is thought to contribute expression on the cell surface.

In one embodiment the cytoplasmic domain of the B7 protein is present. In one embodiment the cytoplasmic domain is absent. The absence of the cytoplasmic domain may reduce or eliminate intracellular signaling to the cancer cell, which is relevant to one or more embodiments discussed below.

The elements in a fragment or full length B7 protein may be from the same or different B7 proteins. Thus in one embodiment the B7 fragment or protein is chimeric.

In one embodiment the virus of the present disclosure encodes multiple proteins for expression on the surface of the infected cancer cell, for example a non-adenovirus encodes at least one is a B7 protein or an active fragment thereof, for example two, three, four or more different proteins are encoded, in particular two or three proteins are encoded by the virus for expression on the cancer cell surface or secretion into the extracellular space.

In one embodiment a B7 protein or active fragment is encoded by the non-adenovirus of the present disclosure for expression on the surface of the cancer cell and a soluble form, which is released or secreted from the cell, of the same B7 protein or a different B7 protein (including active fragments) is also encoded by the virus.

In one embodiment at least two different B7 proteins or active fragments are encoded by a non-adenovirus of the present disclosure.

In one embodiment the multiple proteins may be encoded to be expressed as separate proteins which are independently processed and expressed in the cancer cell membrane. The independence of the proteins on the surface of the cancer cell may make a positive contribution to the immune activation. Whilst not wishing to be bound by theory, lipid packing can influence the fluidity (i.e. the viscosity) of the lipid bilayer in the membrane of the cancer cell. Viscosity of the membrane can affect the rotation and orientation of proteins and other bio-molecules within the membrane, thereby affecting the functions of these molecules. Thus when the proteins encoded by the virus are located as individual and separate proteins within the membrane of the infected cancer cell, the fluidity of the lipid bilayer allows independent movement of the molecules which may be a particularly suitable format similar to a natural format that is conducive to biological function.

In one embodiment the independently processed and expressed proteins are located (anchored) in different locations, such as physically separate locations, in the cancer cell membrane.

In one embodiment one or more proteins (for example all the proteins) encoded by the virus and expressed on the surface of the infected cancer cell are not fusion proteins. Thus in one embodiment the virus according to the present disclosure comprises DNA sequences encoding said multiple proteins for expression, for example on the surface or the infected cancer cell.

Thus in one embodiment the virus according to the present disclosure comprises two or more transgenes, in the same or different locations in the virus genome. When located at the same position in the virus genome the multiple proteins will still be expressed independently at the surface of the cancer cell.

In one embodiment the multiple proteins (including fusion proteins) are encoded in different locations in the virus genome, for example in E3, $B_X$ and/or $B_Y$ and are expressed separately on the surface of the infected cancer cell.

In one embodiment the multiple proteins (including fusion proteins) are encoded in the same location in the virus genome and expressed together on the infected cancer cell surface, for example where the proteins encoded are provided as a fusion protein wherein the fusion protein comprises a B7 protein or an active fragment thereof.

In one embodiment the B7 protein in the fusion protein is a full length protein, in particular a protein described herein, such as B7-1 and/or B7-2, fused or linked to another protein of interest or an active fragment thereof. In one embodiment, the fusion protein comprises a transmembrane from a B7 protein. In one embodiment the B7 is an active fragment excluding the transmembrane domain. In the latter embodiment a transmembrane other than one derived from a B7 protein may be employed to ensure the fusion protein is presented on the surface of the infected cancer cell.

In one embodiment the multiple proteins are encoded in the same location in the virus and are expressed as fusion proteins together on the surface of the infected cancer cell.

When the location in the virus is the same then the genes may, for example be linked by an IRES sequence or a 2A peptide.

In one embodiment the virus according to the present disclosure comprises a "second" transgene and optionally a third transgene (i.e. one or more of said multiple proteins, for example encoding a polypeptide selected from the group comprising a cytokine, a chemokine, a ligand, an antagonistic antibody molecule, and an agonistic antibody molecule.

In one embodiment the additional protein or proteins is/are independently selected from the group comprising an antibody, antibody fragment or protein ligand that binds CD3, CD28, CD80, CD86, 4-1BB, GITR, OX40, CD27, CD40 and combinations in forms suitable for expression on the surface of a cancer cell.

In one embodiment where the first transgene is specific to the alpha and/or beta chain of the TCR the additional protein is an anti-CD3 antibody or binding fragment thereof, for example independently selected from a Muromonab-CD3 (also known as OKT3), otelixizumab (also known as TRX4), teplizumab (also known as hOKT3γ1(Ala-Ala)), or visilizumab.

In one embodiment the anti-TCR antibody is in the form of an antibody fragment (such as an anti-CD3 antibody or binding fragment thereof), for example an scFv form, that is part of a fusion protein with the transmembrane region of another protein, for example the transmembrane domain from the PDGF receptor or from the cell surface form of IgG In one embodiment an antibody inhibitor (antagonistic antibody) is independently selected from the group comprising an inhibitor of an angiogenesis factor, such as an anti-VEGF antibody molecule, and inhibitor of T cell deactivation factors, such as an anti-CTLA-4, anti-PD1 or anti-PDL1 antibody molecule. In one embodiment antibody molecule is an agonist independently selected from the group comprising antibodies to CD40, GITR, OX40, CD27 and 4-1BB.

In one embodiment the additional transgene encodes a cytokine, or soluble variant thereof selected from the group comprising IL-2, IFN-alpha, IFN-beta, IFN-gamma, GM-CSF, IL-15, IL-12 and fms-related tyrosine kinase 3 ligand (FLT3L). Advantageously, one or more of this group of proteins expressed by the virus, in particular as a free protein secreted from the cancer cell, may be particularly suitable for stimulating an immune response in vivo to the cancer cell.

In one embodiment the additional transgene encodes a chemokine, selected from the group comprising MIP1-alpha, RANTES, IL-8, CCL5, CCL17, CCL20, CCL22, CXCL9, CXCL10, CXCL11, CXCL13, CXCL12, CCL2, CCL19 and CCL21. Advantageously, one or more of this group of proteins is expressed by the virus as a free protein which may be secreted from the cancer cell may be particularly suitable for attracting immune cells and stimulating an immune response to the cancer cell in vivo.

In one embodiment the additional transgene encodes a ligand specific for a chemokine receptor, selected from the group comprising CXCR2, CCR2, CCR4, CCR5, CCR6, CCR7, CCR8, CXCR3, CXCR4, CXCR5 and CRTH2.

In one embodiment in addition to at least the anti-TCR antibody or binding fragment thereof (such as an anti-CD3 antibody or binding fragment thereof) expressed on the surface of the infected cancer cell, one or more molecules are also expressed on the surface and/or secreted.

Thus in one embodiment the non-adenovirus encodes B7-1, B7-2 or an active fragment of any one of the same or a combination thereof.

Thus in one embodiment the non-adenovirus encodes B7-1, B7-2 or an active fragment of any one of the same or a combination thereof for expression on the surface of the infected cancer cell and an anti-TCR (agonist, such as CD3 agonist) antibody or antibody fragment (such as a scFv) also for expression on the cancer cell surface, in particular where the proteins are expressed as individual proteins on the cell surface.

Thus in one embodiment the non-adenovirus encodes B7-1, B7-2 or an active fragment of any one of the same or a combination thereof for expression on the surface of the infected cancer cell and an anti-VEGF (antagonist) antibody also for expression on the cancer cell surface or for release from the cancer cell, for example by secretion or after lysis/death of the infected cancer cell.

Thus in one embodiment the non-adenovirus encodes B7-1, B7-2 or an active fragment of any one of the same or a combination thereof for expression on the surface of the infected cancer cell and an antibody, antibody fragment or protein ligand that binds CD3, CD28, CD80, CD86, 4-1BB, GITR, OX40, CD27, CD40 also for expression on the cancer cell surface or for release from the cancer cell, for example by secretion or after lysis/death of the infected cancer cell.

Thus in one embodiment the non-adenovirus encodes B7-1, B7-2 or an active fragment of any one of the same or a combination thereof for expression on the surface of the infected cancer cell and a cytokine selected from IL-2, IFN-alpha, IFN-beta, IFN-gamma, GM-CSF, IL-15, IL-12, and FLT3L, for example for release from the cancer cell, in particular by secretion or after cell lysis/death of the infected cancer cell.

Thus in one embodiment the non-adenovirus encodes B7-1, B7-2 or an active fragment of any one of the same or a combination thereof for expression on the surface of the infected cancer cell and a chemokine selected from MIP1-alpha, RANTES, IL-8, CCL5, CCL17, CCL20, CCL22, CXCL9, CXCL10, CXCL11, CXCL13, CXCL12, CCL2, CCL19, CCL21, for example for release from the cancer cell, in particular by secretion or after cell lysis/death of the infected cancer cell.

Thus in one embodiment the non-adenovirus encodes B7-1, B7-2 or an active fragment of any one of the same or a combination thereof for expression on the surface of the infected cancer cell and an anti-TCR (agonist, such as CD3 agonist) antibody or antibody fragment (such as a ScFv) also for expression on the cancer cell surface (in particular where the proteins are expressed as individual proteins on the cell surface) and further encodes a cytokine or chemokine selected from IL-2, IFN-alpha, IFN-gamma, GM-CSF, IL-15, IL-12, FLT3L, MIP1-alpha, RANTES, IL-8, CCL5, CCL17, CCL20, CCL22, CXCL9, CXCL10, CXCL11, CXCL13, CXCL12, CCL2, CCL19, CCL21 for example for release from the cancer cell, in particular by secretion or after cell lysis/death of the infected cancer cell.

Thus in one embodiment the non-adenovirus encodes B7-1, B7-2 or an active fragment of any one of the same or a combination thereof for expression on the surface of the infected cancer cell and an anti-TCR (agonist) antibody or antibody fragment (such as a ScFv) also for expression on the cancer cell surface (in particular where the proteins are expressed as individual proteins on the cell surface) and further encodes an antibody, antibody fragment or protein ligand that binds CD28, CD80, CD86, 4-1BB, GITR, OX40, CD27, CD40 or an anti-VEGF (antagonist) antibody also for expression on the cancer cell surface or for release from the cancer cell, for example by secretion or after lysis/death of the infected cancer cell.

Thus in one embodiment the non-adenovirus encodes B7-1, B7-2 or an active fragment of any one of the same or a combination thereof for expression on the surface of the infected cancer cell and two different cytokines or chemokines selected from IL-2, IFN-alpha, IFN-beta, IFN-gamma, GM-CSF, IL-15, and IL-12, FLT3L, MIP1-alpha, RANTES, IL-8, CCL5, CCL17, CCL20, CCL22, CXCL9, CXCL10, CXCL11, CXCL13, CXCL12, CCL2, CCL19, CCL21, for example for release from the cancer cell, in particular by secretion of after cell lysis/death of the infected cancer cell.

Thus in one embodiment the non-adenovirus encodes B7-1, B7-2 or an active fragment of any one of the same or a combination thereof for expression on the surface of the infected cancer cell and an anti-TCR (agonist, such as CD3 agonist) antibody or antibody fragment (such as a scFv) also for expression on the cancer cell surface (in particular where the proteins are expressed as individual proteins on the cell surface) and further encodes a cytokine selected from IL-2, IFN-alpha, IFN-gamma, GM-CSF, IL-15, and IL-12, and or a chemokine selected from RANTES (CCL5), MIP1α (LD78α (CCL3) or LD78β (CCL3L1) isoforms), MIP1β which can be released from the cancer cell, in particular by secretion before and after cell lysis/death of the infected cancer cell.

In one embodiment which in particular may be combined with any of the embodiments above the virus further encodes an anti-PD-1 antibody (an antagonist).

In one embodiment the protein or proteins encoded in the transgene cassette for cell membrane expression may also comprise a peptide linker or spacer between the transmembrane domain and the extracellular ligand binding domain. Such linkers or spacers may add flexibility to the cell surface expressed protein that enhances the ability of the protein to interact with its target molecule on an adjacent cell. Such linkers or spacers may also be designed or selected to promote dimerisation or trimerisation of the proteins at the cell surface, via disulphide bond formation or protein-protein interactions. For example the hinge regions of immunoglobulin molecules or CD8 may be employed to enhance both flexibility and dimerisation In one embodiment the protein or proteins encoded in the transgene cassette may also comprise a peptide tag. The peptide tag may include c-myc, poly-histidine, V5 or FLAG tags and can be located on the N-terminus or C-terminus of the polypeptide, either intracellularly or extracellularly, or may be encoded within the protein for example in an extracellular loop or between the transmembrane domain and the extracellular domain. Peptide tags can be used as spacers or linkers between different protein domains, for example the transmembrane and the extracellular domain, and be used for detection or purification of the protein.

In one embodiment the one or more additional transgenes (other than the gene encoding the B7 protein or fragment thereof) is under the control of an exogenous or endogenous promoter, for example an endogenous promoter. In one embodiment a transgene in the E3 region ($B_2$) is under control of an exogenous promoter.

In one embodiment the one or more additional transgenes genes are between the E3 region and the fibre L5 in the adenovirus genome, for example at a position $B_X$ in the construct of formula (I), in particular under the control of an exogenous promoter. In one embodiment a transgene in $B_X$ is under the control of an exogenous.

In one embodiment the one or more additional transgenes genes are between the E4 region and the fibre L5 in the adenovirus genome, for example at a position $B_Y$ in the construct of formula (I) or (Ia), in particular under the control of an endogenous promoter, such as the major late promoter. This may be in addition to the gene encoding the anti-TCR antibody or binding fragment thereof (such as an anti-CD3 antibody or binding fragment thereof) encoded in the region $B_Y$.

In one embodiment there is provided a composition comprising an oncolytic virus or viral vector according to the present disclosure, for example a pharmaceutical composition, in particular comprising a pharmaceutically acceptable excipient, such as a diluent or carrier.

In one embodiment there is provided an oncolytic virus or viral vector according to the present disclosure or a composition comprising the same, for use in treatment, in particular for use in the treatment of cancer.

In one embodiment there is provided a method of treating a patient in need thereof comprising administering a therapeutically effective amount of an oncolytic virus or viral vector according to the present disclosure or a composition, such as a pharmaceutical composition comprising the same.

In one embodiment there is provided use of an oncolytic virus or viral vector according to the present disclosure or a composition comprising the same for the manufacture of a medicament for the treatment of cancer, in particular carcinomas, for example colorectal, lung, bladder, renal, pancreatic, hepatic, head and neck, breast or ovarian cancer.

In one embodiment there is provided a polynucleotide comprising genomic sequence of at least 50% of a virus according to the present disclosure (for example 55, 60, 65, 70, 75, 80, 85, 90, 91, 92, 93, 94, 95, 96, 97, 98, 99 or 100%) and comprising a sequence encoding an anti-TCR antibody or binding fragment thereof (such as an anti-CD3 antibody or binding fragment thereof), for example a sequence disclosed herein. In one embodiment the polynucleotide sequence is in the form of a plasmid.

In one embodiment there is provided a host cell, for example a mammalian cell, such as a HEK293 cell or a derivative thereof, comprising an oncolytic virus or viral vector according to the present disclosure or a polynucleotide sequence according to the present disclosure.

In one embodiment there is provided a process for preparing an oncolytic virus or viral vector according to the present disclosure comprising a step of inserting a polynucleotide encoding an anti-TCR antibody or binding fragment thereof (such as an anti-CD3 antibody or binding fragment thereof) into an oncolytic virus or viral vector.

In one embodiment there is provided a process of replicating a virus or viral according to the present disclosure comprising the step of culture host cells in the presence of the virus under conditions suitable for replication. Generally the method will comprise a further step of harvesting the virus, for example from the supernatant or after lysis of the host cells.

Transgene as employed herein refers to a gene that has been inserted into the genome sequence of the virus or viral vector, wherein the gene is unnatural to the virus (exogenous) or not normally found in that particular location in the virus. Examples of transgenes are given herein. Transgene as employed herein also includes a functional fragment of the gene that is a portion of the gene which when inserted is suitable to perform the function or most of the function of the full-length gene, for example 50% of the function or more. In one embodiment the gene encodes a protein. In one embodiment the virus or vector according to the present disclosure does not contain more than 4 transgenes, which encode a protein or proteins. In one embodiment the virus of vector contains, 3, 2 or 1 transgene that encode a protein or proteins.

Transgene and coding sequence are used interchangeably herein in the context of inserts into the viral genome, unless the context indicates otherwise. Coding sequence as employed herein means, for example a DNA sequence encoding a functional RNA, peptide, polypeptide or protein. Typically the coding sequence is cDNA for the transgene that encodes the functional RNA, peptide, polypeptide or protein of interest. Functional RNA, peptides, polypeptide and proteins of interest are described below.

In one embodiment transgene as employed herein refers to a segment of DNA containing a gene or cDNA sequence that has been isolated from one organism and is introduced into a different organism i.e. the virus of the present disclosure. In one embodiment this non-native segment of DNA will generally retain the ability to produce functional RNA, peptide, polypeptide or protein. Transgenes employed may for example encode a chimeric protein or a fusion protein.

Clearly the virus genome contains coding sequences of DNA. Endogenous (naturally occurring genes) in the genomic sequence of the virus are not considered a transgene, within the context of the present specification unless then have been modified by recombinant techniques such as that they are in a non-natural location or in a non-natural environment.

Thus in one embodiment the transgene inserted encodes a human or humanised protein, polypeptide or peptide.

Fusion protein as employed herein refers to at least two proteins or fragments or a combination of at least one protein and at least one fragment fused directly or attached to each other, for example by a linker. In one embodiment fusion proteins of the present disclosure do not comprise a B7 protein or active fragment thereof. Fusion proteins comprising B7 fragments or protein and additional proteins are not referred to as chimeric proteins herein. Only proteins containing fragments from different B7 proteins are referred to as chimeric herein.

The activity of a given protein fragment may be analysed in a relevant in vitro assay, for example using full-length protein as a comparator.

A chimeric fragment as employed herein refers a fragment comprising a sequence from two or more proteins from different origins.

B7 proteins include B7-1 (also known as CD80 uniprot number P33681), B7-2 (also known as CD86 uniprot number P42081). These proteins bind CD28 and CTLA-4.

In one embodiment CD80 has the sequence shown ins SEQ ID NO: 111 of the associated sequence listing.

Other B7 proteins include B7-DC (also known as PDCD1LG2 and PD-L2 uniprot number Q9BQ51), B7-H1 (also known as PD-L1 and CD274 uniprot number Q9NZQ7). Both these proteins bind PD-1.

Programmed death-ligand 1 (PD-L1) is a 40 kDa type 1 transmembrane protein that has been speculated to play a major role in suppressing the immune system. It appears that upregulation of PD-L1 may allow cancers to evade the host immune system. An analysis of 196 tumor specimens from patients with renal cell carcinoma found that high tumor expression of PD-L1 was associated with increased tumor aggressiveness and a 4.5-fold increased risk of death. Ovarian cancer patients with higher expression of PD-L1 had a significantly poorer prognosis than those with lower expression. PD-L1 expression correlated inversely with intraepithelial CD8+ T-lymphocyte count, suggesting that PD-L1 on tumor cells may suppress antitumor CD8+ T cells. The effect might be tumor type dependent; a study on patients with non-small cell lung cancer showed that greater PD-L1 protein and mRNA expression is associated with increased local lymphocytic infiltrate and longer survival. A number of anti-PDL1 antibodies have been shown to be of interest for treating several cancers in clinical trials.

In one embodiment at least the cytoplasmic (intracellular domain of B7-DC and/or B7-H1 is deleted or non-functional. Whilst not wishing to be bound by theory there is evidence to suggest that removal of the intracellular domain reduces the cancer cells resistance to lysis Blood 2008 Apr. 1; 111(7) 3635-3643.

In one embodiment only the transmembrane domain fragment of B7-DC and/or B7-H1 is employed. In one embodiment the following proteins are not provided as full-length proteins B7-DC and B7-H1.

Other B7 proteins include B7-H2 (also known as ICOSLG, B7RP1, CD275 uniprot number O75144) which binds ICOS, B7-H3 (also known as CD276 uniprot number QSZPR3), B7-H4 (also known as VTCN1 uniprot number Q727D3), B7-H5 (also known as VISTA, Platelet receptor Gi24, SISP1), B7-H6 (also known as NCR3LG1, NR3L1) which binds NKp30, B7-H7 (also known as HHLA2) which binds CD28H.

In one embodiment the fragment only comprises the transmembrane domain of any one B7-H2, B7-H3, B7-H4, B7-H5, B7-H6 and B7-H7.

Individual proteins include single proteins, that is proteins or active fragments thereof that are not part of a fusion protein (including chimeric proteins), and also fusion proteins. In one embodiment the individual proteins are single proteins (including active fragments thereof).

GPI anchor as employed herein refers to is a glycolipid that can be attached to the C-terminus of a protein during posttranslational modification. It is composed of a phosphatidylinositol group linked through a carbohydrate-containing linker (glucosamine and mannose glycosidically bound to the inositol residue) and via an ethanolamine phosphate (EtNP) bridge to the C-terminal amino acid of a mature protein. The two fatty acids within the hydrophobic phosphatidyl-inositol group anchor the protein to the cell membrane.

Glypiated (GPI-linked) proteins contain a signal peptide, thus directing them into the endoplasmic reticulum (ER). The C-terminus is composed of hydrophobic amino acids that stay inserted in the ER membrane. The hydrophobic end is then cleaved off and replaced by the GPI-anchor. As the protein processes through the secretory pathway, it is transferred via vesicles to the Golgi apparatus and finally to the extracellular space where it remains attached to the exterior leaflet of the cell membrane. Since the glypiation is the sole means of attachment of such proteins to the membrane, cleavage of the group by phospholipases will result in controlled release of the protein from the membrane. The latter mechanism is used in vitro; i.e., the membrane proteins released from the membranes in the enzymatic assay are glypiated protein.

Phospholipase C (PLC) is an enzyme that is known to cleave the phospho-glycerol bond found in GPI-anchored proteins. Treatment with PLC will cause release of GPI-linked proteins from the outer cell membrane. The T-cell marker Thy-1 and acetylcholinesterase, as well as both intestinal and placental alkaline phosphatases, are known to be GPI-linked and are released by treatment with PLC. GPI-linked proteins are thought to be preferentially located in lipid rafts, suggesting a high level of organization within plasma membrane microdomains. A review of GPI anchors written by Ferguson, Kinoshita and Hart is available in Chapter 11 of Essentials of Glycobiology 2nd Edition.

Virus as employed herein refers to an oncolytic replication competent virus (or adenovirus) or a replication deficient viral vector (adenoviral vector) unless the context indicates otherwise.

In one embodiment the adenovirus is a human adenovirus. "Adenovirus", "serotype" or adenoviral serotype" as employed herein refers to any adenovirus that can be assigned to any of the over 50 currently known adenoviral serotypes, which are classified into subgroups A-F, and further extends to any, as yet, unidentified or unclassified adenoviral serotypes. See, for example, Strauss, "Adenovirus infections in humans," in The Adenoviruses, Ginsberg, ea., Plenum Press, New York, N.Y., pp. 451-596 (1984) and Shenk, "Adenoviridae: The Viruses and Their Replication," in Fields Virology, Vol. 2, Fourth Edition, Knipe, 35ea., Lippincott Williams & Wilkins, pp. 2265-2267 (2001), as shown in Table 2.

| SubGroup | Adenoviral Serotype |
|---|---|
| A | 12, 18, 31 |
| B | 3, 7, 11, 14, 16, 21, 34, 35, 51 |
| C | 1, 2, 5, 6 |
| D | 8-10, 13, 15, 17, 19, 20, 22-30, 32, 33, 36-39, 42-49, |
| E | 4 |
| F | 40, 41 |

In one embodiment the adenovirus is a subgroup B, for example independently selected from the group comprising or consisting of: Ad3, Ad7, Ad11, Ad14, Ad16, Ad21, Ad34 and Ad51, such as Ad11, in particular Ad11p (the Slobitski strain). In one embodiment the adenovirus of the invention has the capsid, such as the hexon and/or fibre of a subgroup B adenovirus, such as Ad11, in particular Ad11p. In one embodiment the adenovirus is Ad11 or has the fibre and/or hexon and/or penton of Ad11, such as Ad11p.

In one embodiment it is not a group A virus.

Enadenotucirev (EnAd) is a chimeric oncolytic adenovirus, formerly known as EnAd (WO2005/118825), with fibre, penton and hexon from Ad11p, hence it is a subgroup B virus. It has a chimeric E2B region, which comprises DNA from Ad11p and Ad3. Almost all of the E3 region and part of the E4 region is deleted in EnAd. Therefore, it has significant space in the genome to accommodate additional genetic material whilst remaining viable. Furthermore, because EnAd is a subgroup B adenovirus, pre-existing immunity in humans is less common than, for example, Ad5. Other examples of chimeric oncolytic viruses with Ad11 fibre, penton and hexon include OvAd1 and OvAd2 (see WO2006/060314).

EnAd seems to preferentially infect tumour cells, replicates rapidly in these cells and causes cell lysis. This, in turn, can generate inflammatory immune responses thereby stimulating the body to also fight the cancer. Part of the success of EnAd is hypothesised to be related to the fast replication of the virus in vivo.

Importantly, it has been demonstrated clinically that EnAd can be administered systemically (e.g. by intravenous or intraperitoneal injection or infusion) and then subsequently selectively infect and express proteins within tumour cells. This property of EnAd, which may be shared by Ad11p and other group B adenoviruses in particular those expressing the capsid proteins of Ad11p (such as those described herein), makes it possible to express proteins on the surface of cancer cells without having to directly inject the transgenes into the tumour which is not feasible for many cancers.

A derivative of Ad11 virus as employed herein refers to a virus with at least the capsid of Ad11.

Whilst EnAd selectively lyses tumour cells, it may be possible to introduce further beneficial properties, for example increasing the therapeutic activity of the virus or reducing side-effects of the virus by arming it with transgenes, such as a transgene which encodes a cell signalling protein or an antibody, or a transgene which encodes an entity which stimulates a cell signalling protein(s).

Advantageously arming a virus, with DNA encoding certain proteins that can be expressed inside the cancer cell, may enable the body's own defenses to be employed to combat tumour cells more effectively, for example by making the cells more visible to the immune system or by delivering a therapeutic gene/protein preferentially to target tumour cells.

In one embodiment the oncolytic virus or viral of the present disclosure stimulates the patient's immune system to fight the tumor, for example In one embodiment the oncolytic virus has a fibre, hexon and penton proteins from the same serotype, for example Ad11, in particular Ad11p, for example found at positions 30812-31789, 18254-21100 and 13682-15367 of the genomic sequence of the latter wherein the nucleotide positions are relative to Genbank ID 217307399 (accession number: GC689208).

In one embodiment the adenovirus is enadenotucirev (also known as EnAd and formerly as ColoAd1). Enadenotucirev as employed herein refers the chimeric adenovirus of SEQ ID NO: 21. It is a replication competent oncolytic chimeric adenovirus which has enhanced therapeutic properties compared to wild type adenoviruses (see WO2005/118825). EnAd has a chimeric E2B region, which features DNA from Ad11p and Ad3, and deletions in E3/E4. The structural changes in enadenotucirev result in a genome that is approximately 3.5 kb smaller than Ad11p thereby providing additional "space" for the insertion of transgenes.

Linkers suitable for use in fusion proteins of the present disclosure include:
  hinge linker sequences shown in SEQ ID NO: 22 to 30 (see associated sequence listing);
  flexible linker sequences GS and also the sequences shown in SEQ ID NO: 31 to 70 (see associated sequence listing);
  linker sequences shown in SEQ ID NO: 73 to 86

Examples of rigid linkers include the peptide sequences GAPAPAAPAPA (SEQ ID NO: 71), PPPP (SEQ ID NO: 72) and PPP.

Definitions Relevant to Formula (I) and (Ia)

A bond refers to a covalent bond connecting the one DNA sequence to another DNA sequence, for example connecting one section of the virus genome to another. Thus when a variable in formula (I) and (Ia) herein represents a bond the feature or element represented by the bond is absent i.e. deleted.

As the structure of adenoviruses is, in general, similar the elements below are discussed in terms of the structural elements and the commonly used nomenclature referring thereto, which are known to the skilled person. When an element is referred to herein then we refer to the DNA sequence encoding the element or a DNA sequence encoding the same structural protein of the element in an adenovirus. The latter is relevant because of the redundancy of the DNA code. The viruses' preference for codon usage may need to be considered for optimised results.

Any structural element from an adenovirus employed in the viruses of the present disclosure may comprise or consist of the natural sequence or may have similarity over the given length of at least 95%, such as 96%, 97%, 98%, 99% or 100%. The original sequence may be modified to omit 10%, 9%, 8%, 7%, 6%, 5%, 4%, 3%, 2% or 1% of the genetic material. The skilled person is aware that when making changes the reading frames of the virus must be not disrupted such that the expression of structural proteins is disrupted.

In one embodiment the given element is a full-length sequence i.e. the full-length gene.

In one embodiment the given element is less than a full-length and retains the same or corresponding function as the full-length sequence.

In one embodiment for a given element which is optional in the constructs of the present disclosure, the DNA sequence may be less than a full-length and have no functionality, for example the E3 region may be totally or partly deleted.

The structural genes encoding structural or functional proteins of the adenovirus are generally linked by non-coding regions of DNA. Thus there is some flexibility about where to "cut" the genomic sequence of the structural element of interest (especially non-coding regions thereof) for the purpose of inserting a transgene into the viruses of the present disclosure. Thus for the purposes of the present specification, the element will be considered a structural element of reference to the extent that it is fit for purpose and does not encode extraneous material. Thus, if appropriate the gene will be associated with suitable non-coding regions, for example as found in the natural structure of the virus.

Thus in one embodiment an insert, such as DNA encoding a restriction site and/or transgene, is inserted into a non-coding region of genomic virus DNA, such as an intron or intergenic sequence. Having said this some non-coding regions of adenovirus may have a function, for example in alternative splicing, transcription regulation or translation regulation, and this may need to be taken into consideration.

The sites identified herein, that are associated with the L5 region, are suitable for accommodating a variety of DNA sequences encoding complex entities such as RNAi, cytokines, single chain or multimeric proteins, such as antibodies.

Gene as employed herein refers to coding and any non-coding sequences associated therewith, for example introns and associated exons. In one embodiment a gene comprises or consists of only essential structural components, for example coding region.

Below follows a discussion relating to specific structural elements of adenoviruses.

The Inverted Terminal Repeat (ITR) sequences are common to all known adenoviruses and were so named because of their symmetry, and are the viral chromosome origins of replication. Another property of these sequences is their ability to form a hairpin.

The 5'ITR as employed herein refers to part or all of an ITR from the 5' end of an adenovirus, which retains the function of the ITR when incorporated into an adenovirus in an appropriate location. In one embodiment the 5'ITR comprises or consists of the sequence from about 1 bp to 138 bp of SEQ ID NO: 21 or a sequence 90, 95, 96, 97, 98 or 99% identical thereto along the whole length, in particular the sequence consisting of from about 1 bp to 138 bp of SEQ ID NO: 21.

The 3'ITR as employed herein refers to part or all of an ITR from 3' end of an adenovirus which retains the function of the ITR when incorporated into an adenovirus in an appropriate location. In one embodiment the 3'ITR comprises or consists of the sequence from about 32189 bp to 32326 bp of SEQ ID NO: 21 or a sequence 90, 95, 96, 97, 98 or 99% identical thereto along the whole length, in particular the sequence consisting of from about 32189 bp to 32326 bp of SEQ ID NO: 21.

B1 as employed herein refers to the DNA sequence encoding: part or all of an E1A from an adenovirus, part or all of the E1B region of an adenovirus, and independently part or all of E1A and E1B region of an adenovirus.

When B1 is a bond then E1A and E1B sequences will be omitted from the virus. In one embodiment B1 is a bond and thus the virus is a vector.

In one embodiment B1 further comprises a transgene. It is known in the art that the E1 region can accommodate a transgene which may be inserted in a disruptive way into the E1 region (i.e. in the "middle" of the sequence) or part or all of the E1 region may be deleted to provide more room to accommodate genetic material.

E1A as employed herein refers to the DNA sequence encoding part or all of an adenovirus E1A region. The latter here is referring to the polypeptide/protein E1A. It may be mutated such that the protein encoded by the E1A gene has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

E1B as employed herein refers to the DNA sequence encoding part or all of an adenovirus E1B region (i.e. polypeptide or protein), it may be mutated such that the protein encoded by the E1B gene/region has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

Thus B1 can be modified or unmodified relative to a wild-type E1 region, such as a wild-type E1A and/or E1B. The skilled person can easily identify whether E1A and/or E1B are present or (part) deleted or mutated.

Wild-type as employed herein refers to a known adenovirus. A known adenovirus is one that has been identified and named, regardless of whether the sequence is available.

In one embodiment B1 has the sequence from 139 bp to 3932 bp of SEQ ID NO: 21.

$B_A$ as employed herein refers to the DNA sequence encoding the E2B-L1-L2-L3-E2A-L4 regions including any non-coding sequences, as appropriate (in particular corresponding to the natural sequence from an adenovirus). Generally this sequence will not comprise a transgene. In one embodiment the sequence is substantially similar or identical to a contiguous sequence from a known adenovirus, for example a serotype shown in Table 1, in particular a group B virus, for example Ad3, Ad7, Ad11, Ad14, Ad16, Ad21, Ad34, Ad35, Ad51 or a combination thereof, such as Ad3, Ad11 or a combination thereof. In one embodiment is E2B-L1-L2-L3-E2A-L4 refers to comprising these elements and other structural elements associated with the region, for example BA will generally include the sequence encoding the protein IV2a, for example as follows: IV2A IV2a-E2B-L1-L2-L3-E2A-L4.

In one embodiment the E2B region is chimeric. That is, comprises DNA sequences from two or more different adenoviral serotypes, for example from Ad3 and Ad11, such as Ad11p. In one embodiment the E2B region has the sequence from 5068 bp to 10355 bp of SEQ ID NO: 21 or a sequence 95%, 96%, 97%, 98% or 99% identical thereto over the whole length.

In one embodiment the E2B in component $B_A$ comprises the sequences shown in SEQ ID NO: 87 (which corresponds to SEQ ID NO: 3 disclosed in WO2005/118825).

In one embodiment BA has the sequence from 3933 bp to 27184 bp of SEQ ID NO: 21.

E3 as employed herein refers to the DNA sequence encoding part or all of an adenovirus E3 region (i.e. protein/polypeptide), it may be mutated such that the protein encoded by the E3 gene has conservative or non-conservative amino acid changes, such that it has the same function as wild-type (the corresponding unmutated protein); increased function in comparison to wild-type protein; decreased function, such as no function in comparison to wild-type protein or has a new function in comparison to wild-type protein or a combination of the same, as appropriate.

In one embodiment the E3 region is form an adenovirus serotype given in Table 1 or a combination thereof, in particular a group B serotype, for example Ad3, Ad7, Ad11 (in particular Ad11p), Ad14, Ad16, Ad21, Ad34, Ad35, Ad51 or a combination thereof, such as Ad3, Ad11 (in particular Ad11p) or a combination thereof.

In one embodiment the E3 region is partially deleted, for example is 95%, 90%, 85%, 80%, 75%, 70%, 65%, 60%, 55%, 50%, 45%, 40%, 35%, 30%, 25%, 20%, 15%, 10%, 5% deleted.

In one embodiment $B_2$ is a bond, wherein the DNA encoding the E3 region is absent.

In one embodiment the DNA encoding the E3 region can be replaced or interrupted by a transgene. As employed herein "E3 region replaced by a transgene as employed herein includes part or all of the E3 region is replaced with a transgene.

In one embodiment the $B_2$ region comprises the sequence from 27185 bp to 28165 bp of SEQ ID NO: 21.

In one embodiment $B_2$ consists of the sequence from 27185 bp to 28165 bp of SEQ ID NO: 21.

$B_X$ as employed herein refers to the DNA sequence in the vicinity of the 5' end of the L5 gene in BB. In the vicinity of or proximal to the 5' end of the L5 gene as employed herein refers to: adjacent (contiguous) to the 5' end of the L5 gene or a non-coding region inherently associated herewith i.e. abutting or contiguous to the 5' prime end of the L5 gene or a non-coding region inherently associated therewith. Alternatively, in the vicinity of or proximal to may refer to being close the L5 gene, such that there are no coding sequences between the BX region and the 5' end of L5 gene.

Thus in one embodiment $B_X$ is joined directly to a base of L5 which represents, for example the start of a coding sequence of the L5 gene.

Thus in one embodiment $B_X$ is joined directly to a base of L5 which represents, for example the start of a non-coding sequence, or joined directly to a non-coding region naturally associated with L5. A non-coding region naturally associated L5 as employed herein refers to part of all of a non-coding regions which is part of the L5 gene or contiguous therewith but not part of another gene.

In one embodiment $B_X$ comprises the sequence of SEQ ID NO: 88. This sequence is an artificial non-coding sequence wherein a DNA sequence, for example comprising a transgene (or transgene cassette), a restriction site or a combination thereof may be inserted therein. This sequence is advantageous because it acts as a buffer in that allows some flexibility on the exact location of the transgene whilst minimising the disruptive effects on virus stability and viability.

The insert(s) can occur anywhere within SEQ ID NO: 88 from the 5' end, the 3' end or at any point between bp 1 to 201, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, 34/35, 35/36, 36/37, 37/38, 38/39, 39/40, 40/41, 41/42, 42/43, 43/44, 44/45, 45/46, 46/47, 47/48, 48/49, 49/50, 50/51, 51/52, 52/53, 53/54, 54/55, 55/56, 56/57, 57/58, 58/59, 59/60, 60/61, 61/62, 62/63, 63/64, 64/65, 65/66, 66/67, 67/68, 68/69, 69/70, 70/71, 71/72, 72/73, 73/74, 74/75, 75/76, 76/77, 77/78, 78/79, 79/80, 80/81, 81/82, 82/83, 83/84, 84/85, 85/86, 86/87, 87/88, 88/89, 89/90, 90/91, 91/92, 92/93, 93/94, 94/95, 95/96, 96/97, 97/98, 98/99, 99/100, 100/101, 101/102, 102/103, 103/104, 104/105, 105/106, 106/107, 107/108, 108/109, 109/110, 110/111, 111/112, 112/113, 113/114, 114/115, 115/116, 116/117, 117/118, 118/119, 119/120, 120/121, 121/122, 122/123, 123/124, 124/125, 125/126, 126/127, 127/128, 128/129, 129/130, 130/131, 131/132, 132/133, 133/134, 134/135, 135/136, 136/137, 137/138, 138/139, 139/140, 140/141, 141/142, 142/143, 143/144, 144/145, 145/146, 146/147, 147/148, 148/149, 150/151, 151/152, 152/153, 153/154, 154/155, 155/156, 156/157, 157/158, 158/159, 159/160, 160/161, 161/162, 162/163, 163/164, 164/165, 165/166, 166/167, 167/168, 168/169, 169/170, 170/171, 171/172, 172/173, 173/174, 174/175, 175/176, 176/177, 177/178, 178/179, 179/180, 180/181, 181/182, 182/183, 183/184, 184/185, 185/186, 186/187, 187/188, 189/190, 190/191, 191/192, 192/193, 193/194, 194/195, 195/196, 196/197, 197/198, 198/199, 199/200 or 200/201.

In one embodiment $B_X$ comprises SEQ ID NO: 88 with a DNA sequence inserted between bp 27 & bp 28 or a place corresponding to between positions 28192 bp and 28193 bp of SEQ ID NO: 21.

In one embodiment $B_X$ has the sequence from 28166 bp to 28366 bp of SEQ ID NO: 21. In one embodiment $B_X$ is a bond.

$B_B$ as employed herein refers to the DNA sequence encoding the L5 region. As employed herein the L5 region refers to the DNA sequence containing the gene encoding the fibre polypeptide/protein, as appropriate in the context. The fibre gene/region encodes the fibre protein which is a major capsid component of adenoviruses. The fibre functions in receptor recognition and contributes to the adenovirus' ability to selectively bind and infect cells.

In viruses of the present disclosure the fibre can be from any adenovirus serotype and adenoviruses which are chimeric as result of changing the fibre for one of a different serotype are known. In one embodiment the fibre is from a group B virus, in particular Ad11, such as Ad11p.

DNA sequence in relation to $B_Y$ as employed herein refers to the DNA sequence in the vicinity of the 3' end of the L5 gene of $B_B$. In the vicinity of or proximal to the 3' end of the L5 gene as employed herein refers to: adjacent (contiguous) to the 3' end of the L5 gene or a non-coding region inherently associated therewith i.e. abutting or contiguous to the 3' prime end of the L5 gene or a non-coding region inherently associated therewith (i.e. all or part of an non-coding sequence endogenous to L5). Alternatively, in the vicinity of or proximal to may refer to being close the L5 gene, such that there are no coding sequences between the $B_Y$ region and the 3' end of the L5 gene.

Thus in one embodiment $B_Y$ is joined directly to a base of L5 which represents the "end" of a coding sequence.

Thus in one embodiment $B_Y$ is joined directly to a base of L5 which represents the "end" of a non-coding sequence, or joined directly to a non-coding region naturally associated with L5.

Inherently and naturally are used interchangeably herein. In one embodiment $B_Y$ comprises the sequence of SEQ ID NO: 89. This sequence is a non-coding sequence wherein a DNA sequence, for example comprising a transgene (or transgene cassette), a restriction site or a combination thereof may be inserted. This sequence is advantageous because it acts a buffer in that allows some flexibility on the exact location of the transgene whilst minimising the disruptive effects on virus stability and viability.

The insert(s) can occur anywhere within SEQ ID NO: 88 from the 5' end, the 3' end or at any point between bp 1 to 35, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, or 34/35.

In one embodiment $B_Y$ comprises SEQ ID NO: 89 with a DNA sequence inserted between positions bp 12 and 13 or a place corresponding to 29356 bp and 29357 bp in SEQ ID NO: 21. In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two or three transgenes, such as one or two transgenes. In one embodiment the restriction site is a 19 bp restriction site insert comprising 2 restriction sites and at least one transgene, for example one or two transgenes. In one embodiment the restriction site insert is a 9 bp restriction site insert comprising 1 restriction site and at least one transgene, for example one or two transgenes. In one embodiment two restriction sites sandwich one or more, such as two transgenes (for example in a transgene cassette). In one embodiment when BY comprises two restrictions sites the said restriction sites are different from each other. In one embodiment said one or more restrictions sites in $B_Y$ are non-naturally occurring (such as unique) in the particular adenovirus genome into which they have been inserted. In one embodiment said one or more restrictions sites in BY are different to other restrictions sites located elsewhere in the adenovirus genome, for example different to naturally occurring restrictions sites or restriction sites introduced into other parts of the genome, such as BX. Thus in one embodiment the restriction site or sites allow the DNA in the section to be cut specifically.

In one embodiment $B_Y$ has the sequence from 29345 bp to 29379 bp of SEQ ID NO: 21. In one embodiment $B_Y$ is a bond.

In one embodiment the insert is after bp 12 in SEQ ID NO: 89.

In one embodiment the insert is at about position 29356 bp of SEQ ID NO: 21.

In one embodiment the insert is a transgene cassette comprising one or more transgenes, for example 1, 2 or 3, such as 1 or 2.

E4 as employed herein refers to the DNA sequence encoding part or all of an adenovirus E4 region (i.e. polypeptide/protein region), which may be mutated such that the protein encoded by the E4 gene has conservative or non-conservative amino acid changes, and has the same function as wild-type (the corresponding non-mutated protein); increased function in comparison to wild-type protein; decreased function, such as no function in comparison to wild-type protein or has a new function in comparison to wild-type protein or a combination of the same as appropriate.

In one embodiment the E4 region is partially deleted, for example is 95%, 90%, 85%, 80%, 75%, 70%, 65%, 60%, 55%, 50%, 45%, 40%, 35%, 30%, 25%, 20%, 15%, 10% or 5% deleted. In one embodiment the E4 region has the sequence from 32188 bp to 29380 bp of SEQ ID NO: 21.

In one embodiment E4 is present except for the E4orf4 region which is deleted.

In one embodiment $B_3$ is a bond, i.e. wherein E4 is absent.

In one embodiment $B_3$ has the sequence consisting of from 32188 bp to 29380 bp of SEQ ID NO: 21.

As employed herein number ranges are inclusive of the end points.

The skilled person will appreciate that the elements in the formulas herein, such as formula (I), (Ia) are contiguous and may embody non-coding DNA sequences as well as the genes and coding DNA sequences (structural features) mentioned herein. In one or more embodiments the formulas of the present disclosure are attempting to describe a naturally occurring sequence in the adenovirus genome. In this context it will be clear to the skilled person that the formula is referring to the major elements characterising the relevant section of genome and is not intended to be an exhaustive description of the genomic stretch of DNA.

E1A, E1B, E3 and E4 as employed herein each independently refer to the wild-type and equivalents thereof, mutated or partially deleted forms of each region as described herein, in particular a wild-type sequence from a known adenovirus.

"Insert" as employed herein refers to a DNA sequence that is incorporated either at the 5' end, the 3' end or within a given DNA sequence reference segment such that it interrupts the reference sequence. The latter is a reference sequence employed as a reference point relative to which the insert is located. In the context of the present disclosure inserts generally occur within either SEQ ID NO: 88 or SEQ ID NO: 89. An insert can be either a restriction site insert, a transgene cassette or both. When the sequence is interrupted the virus will still comprise the original sequence, but generally it will be as two fragments sandwiching the insert.

In one embodiment the transgene or transgene cassette does not comprise a non-biased inserting transposon, such as a TN7 transposon or part thereof. Tn7 transposon as employed herein refers to a non-biased insertion transposon as described in WO2008/080003.

In one embodiment the transgene or transgene cassette further comprises a regulatory element or sequence.

Other Regulatory Sequences

"Regulator of gene expression" (or regulator/regulatory element) as employed herein refers to a genetic feature, such as a promoter, enhancer or a splice acceptor sequence that plays a role in gene expression, typically by initiating or enhancing transcription or translation.

"Splice acceptor sequence", "splice acceptor" or "splice site" as employed herein refers to a regulatory sequence determining when an mRNA molecule will be recognised by small nuclear ribonucleoproteins of the spliceosome complex. Once assembled the spliceosome catalyses splicing between the splice acceptor site of the mRNA molecule to an upstream splice donor site producing a mature mRNA molecule that can be translated to produce a single polypeptide or protein.

Different sized splice acceptor sequences may be employed in the present invention and these can be described as short splice acceptor (small), splice acceptor (medium) and branched splice acceptor (large).

SSA as employed herein means a short splice acceptor, typically comprising just the splice site, for example 4 bp. SA as employed herein means a splice acceptor, typically comprising the short splice acceptor and the polypyrimidine tract, for example 16 bp. bSA as employed herein means a branched splice acceptor, typically comprising the short splice acceptor, polypyrimidine tract and the branch point, for example 26 bp.

In one embodiment the splice acceptor employed in the constructs of the disclosure are CAGG or SEQ ID NO: 90 or 91. In one embodiment the SSA has the nucleotide sequence CAGG. In one embodiment the SA has the nucleotide sequence of SEQ ID NO: 90. In one embodiment the SA has the nucleotide sequence of SEQ ID NO: 91.

In one embodiment the splice site is immediately proceeded (i.e. followed in a 5' to 3' direction) by a consensus Kozak sequence comprising CCACC. In one embodiment the splice site and the Kozak sequence are interspersed by up to 100 or less bp. In one embodiment the Kozak sequence has the nucleotide sequence of CCACC.

Typically, when under the control of an endogenous or exogenous promoter (such as an endogenous promoter), the coding sequence will be immediately preceded by a Kozak sequence. The start of the coding region is indicated by the initiation codon (AUG), for example is in the context of the sequence (gcc)gccRccAUGg [SEQ ID NO: 92] the start of the start of the coding sequences is indicated by the bases in bold. A lower case letter denotes common bases at this position (which can nevertheless vary) and upper case letters indicate highly-conserved bases, i.e. the 'AUGG' sequence is constant or rarely, if ever, changes; 'R' indicates that a purine (adenine or guanine) is usually observed at this position and the sequence in brackets (gcc) is of uncertain significance. Thus in one embodiment the initiation codon AUG is incorporated into a Kozak sequence.

Internal Ribosome Entry DNA Sequence as employed herein refers to a DNA sequence encoding an Internal Ribosome Entry Sequence (IRES). IRES as employed herein means a nucleotide sequence that allows for initiation of translation a messenger RNA (mRNA) sequence, including initiation starting within an mRNA sequence. This is particularly useful when the cassette encodes polycistronic mRNA. Using an IRES results in a polycistronic mRNA that is translated into multiple individual proteins or peptides. In one embodiment the Internal Ribosome Entry DNA sequence has the nucleotide sequence of SEQ ID NO: 93. In one embodiment a particular IRES is only used once in the genome. This may have benefits with respect to stability of the genome.

"High self-cleavage efficiency 2A peptide" or "2A peptide" as employed herein refers to a peptide which is efficiently cleaved following translation. Suitable 2A peptides include P2A, F2A, E2A and T2A. The present inventors have noted that once a specific DNA sequence encoding a given 2A peptide is used once, the same specific DNA sequence may not be used a second time. However, redundancy in the DNA code may be utilised to generate a DNA sequence that is translated into the same 2A peptide. Using 2A peptides is particularly useful when the cassette encodes polycistronic mRNA. Using 2A peptides results in a single polypeptide chain being translated which is modified post-translation to generate multiple individual proteins or peptides.

In one embodiment the encoded P2A peptide employed has the amino acid sequence of SEQ ID NO: 94. In one embodiment the encoded F2A peptide employed has the amino acid sequence of SEQ ID NO: 95. In one embodiment the encoded E2A peptide employed has the amino acid sequence of SEQ ID NO: 96. In one embodiment the encoded T2A peptide employed has the amino acid sequence of SEQ ID NO: 97.

In one embodiment an mRNA or each mRNA encoded by transgene is/are comprise a polyadenylation signal sequence, such as typically at the end of an mRNA sequence. Thus one embodiment the transgene or the transgene cassette comprises at least one sequence encoding a polyadenylation signal sequence.

"PolyA", "Polyadenylation signal" or "polyadenylation sequence" as employed herein means a DNA sequence, usually containing an AATAAA site, that once transcribed can be recognised by a multiprotein complex that cleaves and polyadenylates the nascent mRNA molecule.

In one embodiment the construct does not include a polyadenylation sequence. In one embodiment the regulator of gene expression is a splice acceptor sequence.

In one embodiment the sequence encoding a protein/polypeptide/peptide, such as an antibody or antibody fragment further comprises a polyadenylation signal.

In one embodiment there is provided a virus or construct with a sequence disclosed herein.

Antibodies

Antibody molecule as employed herein includes any construct comprising a full length antibody or a binding fragment thereof, multispecific antibody formats. Thus the antibody molecules of the present invention include a complete antibody molecule having full length heavy and light chains or a fragment thereof and may be, but are not limited to Fab, modified Fab, Fab', modified Fab', F(ab')2, Fv, Fab-Fv, Fab-dsFv, single domain antibodies (e.g. VH or VL or VHH), scFv, bi, tri or tetra-valent antibodies, Bis-scFv, diabodies, triabodies, tetrabodies and epitope-binding fragments of any of the above (see for example Holliger and Hudson, 2005, Nature Biotech. 23(9):1126-1136; Adair and Lawson, 2005, Drug Design Reviews—Online 2(3), 209-217). The methods for creating and manufacturing these antibody fragments are well known in the art (see for example Verma et al., 1998, Journal of Immunological Methods, 216, 165-181). Other antibody fragments for use in the present invention include the Fab and Fab' fragments described in International patent applications WO2005/003169, WO2005/003170 and WO2005/003171. Multi-valent antibodies may comprise multiple specificities e.g. bispecific or may be monospecific (see for example WO 92/22853 and WO05/113605). Bispecific and multispecific antibody variants are especially considered in this example since the aim is to neutralise two independent target proteins:

Unless the context indicates otherwise antibody will generally refer to a full length antibody. Antibody binding fragment as employed herein refers to less than a full-length antibody, which retains specificity for the target antigen. Antibody binding fragments may include a Fab, Fab', modified Fab', F(ab')2, Fv, Fab-Fv, Fab-dsFv, single domain antibodies (e.g. VH or VL or VHH), scFv, ds-scFv.

In one embodiment antibodies or binding fragments thereof employed in the technology of the present disclosure are monoclonal.

Monoclonal antibodies for use in the present disclosure may be prepared by any method known in the art such as the hybridoma technique (Kohler & Milstein, 1975, Nature, 256:495-497), the trioma technique, the human B-cell hybridoma technique (Kozbor et al., 1983, Immunology Today, 4:72) and the EBV-hybridoma technique (Cole et al., Monoclonal Antibodies and Cancer Therapy, pp 77-96, Alan R Liss, Inc., 1985).

Antibodies for use in the invention may also be generated using single lymphocyte antibody methods by cloning and expressing immunoglobulin variable region cDNAs generated from single lymphocytes selected for the production of specific antibodies by, for example, the methods described by Babcook, J. et al., 1996, Proc. Natl. Acad. Sci. USA 93(15):7843-78481; WO92/02551; WO2004/051268 and International Patent Application number WO2004/106377. Binding domains employed in antibody molecules of the present disclosure may be humanised. Humanised antibodies (which include CDR-grafted antibodies) are antibody molecules having one or more complementarity determining regions (CDRs) from a non-human species and a framework region from a human immunoglobulin molecule (see, e.g. U.S. Pat. No. 5,585,089; WO91/09967). It will be appreciated that it may only be necessary to transfer the specificity determining residues of the CDRs rather than the entire CDR (see for example, Kashmiri et al., 2005, Methods, 36, 25-34). Humanised antibodies may optionally further comprise one or more framework residues derived from the non-human species from which the CDRs were derived.

When the CDRs or specificity determining residues are grafted, any appropriate acceptor variable region framework sequence may be used having regard to the class/type of the donor antibody from which the CDRs are derived, including mouse, primate and human framework regions. Suitably, the humanised antibody according to the present invention has a variable domain comprising human acceptor framework regions as well as one or more of the CDRs provided herein.

Examples of human frameworks which can be used in the present invention are KOL, NEWM, REI, EU, TUR, TEI, LAY and POM (Kabat et al., supra). For example, KOL and NEWM can be used for the heavy chain, REI can be used for the light chain and EU, LAY and POM can be used for both the heavy chain and the light chain. Alternatively, human germline sequences may be used; these are available at: htt://vbase.mrc-cpe.cam.ac.uk/

In a humanised antibody of the present invention, the acceptor heavy and light chains do not necessarily need to be derived from the same antibody and may, if desired, comprise composite chains having framework regions derived from different chains.

Also, in a humanised antibody of the present invention, the framework regions need not have exactly the same sequence as those of the acceptor antibody. For instance, unusual residues may be changed to more frequently-occurring residues for that acceptor chain class or type. Alternatively, selected residues in the acceptor framework regions may be changed so that they correspond to the residue found at the same position in the donor antibody (see Reichmann et al., 1998, Nature, 332, 323-324). Such changes should be kept to the minimum necessary to recover the affinity of the donor antibody. A protocol for selecting residues in the acceptor framework regions which may need to be changed is set forth in WO 91/09967.

The constant region domains of the antibody molecule of the present invention, if present, may be selected having regard to the proposed function of the antibody molecule, and in particular the effector functions which may be required. For example, the constant region domains may be human IgA, IgD, IgE, IgG or IgM domains. In particular, human IgG constant region domains may be used, especially of the IgG1 and IgG3 isotypes when the antibody molecule is intended for therapeutic uses and antibody effector functions are required. Alternatively, IgG2 and IgG4 isotypes may be used when the antibody molecule is intended for therapeutic purposes and antibody effector functions are not required, e.g. for simply neutralising or agonising an antigen. It will be appreciated that sequence variants of these constant region domains may also be used. For example IgG4 molecules in which the serine at position 241 has been changed to proline as described in Angal et al., Molecular Immunology, 1993, 30 (1), 105-108 may be used. It will also be understood by one skilled in the art that antibodies may undergo a variety of posttranslational modifications. The type and extent of these modifications often depends on the host cell line used to express the antibody as well as the culture conditions. Such modifications may include variations in glycosylation, methionine oxidation, diketopiperazine formation, aspartate isomerization and asparagine deamidation. A frequent modification is the loss of a carboxy-terminal basic residue (such as lysine or arginine) due to the action of carboxypeptidases (as described in Harris, R J. Journal of Chromatography 705:129-134, 1995).

Formulations

The present disclosure relates also extends to a pharmaceutical formulation of a virus as described herein.

In one embodiment there is provided a liquid parenteral formulation, for example for infusion or injection, of a replication capable oncolytic virus or replication deficient viral vector according to the present disclosure wherein the formulation provides a dose in the range of $1 \times 10^{10}$ to $1 \times 10^{14}$ viral particles per volume of dose.

Parenteral formulation means a formulation designed not to be delivered through the GI tract. Typical parenteral delivery routes include injection, implantation or infusion. In one embodiment the formulation is provided in a form for bolus delivery.

In one embodiment the parenteral formulation is in the form of an injection. Injection includes intravenous, subcutaneous, intra-tumoral or intramuscular injection. Injection as employed herein means the insertion of liquid into the body via a syringe. In one embodiment the method of the present disclosure does not involve intra-tumoral injection.

In one embodiment the parenteral formulation is in the form of an infusion.

Infusion as employed herein means the administration of fluids at a slower rate by drip, infusion pump, syringe driver or equivalent device. In one embodiment the infusion is administered over a period in the range of 1.5 minutes to 120 minutes, such as about 3, 4, 5, 6, 7, 8, 9, 10, 11, 12, 13, 14 15, 16, 17, 18, 19 20, 25, 30, 35, 40, 45, 50, 55, 60, 65, 70, 65, 80, 85, 90, 95, 100, 105, 110 or 115 minutes.

In one embodiment one dose of the formulation less than 100 mls, for example 30 mls, such as administered by a syringe driver.

In one embodiment the injection is administered as a slow injection, for example over a period of 1.5 to 30 minutes.

In one embodiment the formulation is for intravenous (i.v.) administration. This route is particularly effective for delivery of oncolytic virus because it allows rapid access to the majority of the organs and tissue and is particular useful for the treatment of metastases, for example established metastases especially those located in highly vascularised regions such as the liver and lungs.

Therapeutic formulations typically will be sterile and stable under the conditions of manufacture and storage. The composition can be formulated as a solution, microemulsion, liposome, or other parenteral formulation suitable for administration to a human and may be formulated as a pre-filled device such as a syringe or vial, particular as a single dose.

The formulation will generally comprise a pharmaceutically acceptable diluent or carrier, for example a non-toxic, isotonic carrier that is compatible with the virus, and in which the virus is stable for the requisite period of time.

The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a dispersant or surfactant such as lecithin or a non-ionic surfactant such as polysorbate 80 or 40. In dispersions the maintenance of the required particle size may be assisted by the presence of a surfactant. Examples of isotonic agents include sugars, polyalcohols such as mannitol, sorbitol, or sodium chloride in the composition.

In one embodiment parenteral formulations employed may comprise one or more of the following a buffer, for example 4-(2-hydroxyethyl)-1-piperazineethanesulfonic acid, a phosphate buffer and/or a Tris buffer, a sugar for example dextrose, mannose, sucrose or similar, a salt such as sodium chloride, magnesium chloride or potassium chloride, a detergent such as a non-ionic surfactant such as brij, PS-80, PS-40 or similar. The formulation may also comprise a preservative such as EDTA or ethanol or a combination of EDTA and ethanol, which are thought to prevent one or more pathways of possible degradation.

In one embodiment the formulation will comprise purified oncolytic virus according to the present disclosure, for example $1\times10^{10}$ to $1\times10^{14}$ viral particles per dose, such as $1\times10^{10}$ to $1\times10^{12}$ viral particles per dose. In one embodiment the concentration of virus in the formulation is in the range $2\times10^{8}$ to $2\times10^{14}$ vp/mL, such as $2\times10^{12}$ vp/ml.

In one embodiment the parenteral formulation comprises glycerol.

In one embodiment the formulation comprises oncolytic adenovirus as described herein, HEPES (N-2-hydroxyethylpiperazine-N'-2-ethanesulfonic acid), glycerol and buffer.

In one embodiment the parenteral formulation consists of virus of the disclosure, HEPES for example 5 mM, glycerol for example 5-20% (v/v), hydrochloric acid, for example to adjust the pH into the range 7-8 and water for injection.

In one embodiment 0.7 mL of virus of the disclosure at a concentration of $2\times10^{12}$ vp/mL is formulated in 5 mM HEPES, 20% glycerol with a final pH of 7.8.

A thorough discussion of pharmaceutically acceptable carriers is available in Remington's Pharmaceutical Sciences (Mack Publishing Company, N.J. 1991).

In one embodiment the formulation is provided as a formulation for topical administrations including inhalation.

Suitable inhalable preparations include inhalable powders, metering aerosols containing propellant gases or inhalable solutions free from propellant gases. Inhalable powders according to the disclosure will generally contain a virus as described herein with a physiologically acceptable excipient.

These inhalable powders may include monosaccharides (e.g. glucose or arabinose), disaccharides (e.g. lactose, saccharose, maltose), oligo- and polysaccharides (e.g. dextranes), polyalcohols (e.g. sorbitol, mannitol, xylitol), salts (e.g. sodium chloride, calcium carbonate) or mixtures of these with one another. Mono- or disaccharides are suitably used, the use of lactose or glucose, particularly but not exclusively in the form of their hydrates.

Particles for deposition in the lung require a particle size less than 10 microns, such as 1-9 microns for example from 0.1 to 5 μm, in particular from 1 to 5 μm. The particle size of the carrying the virus is of primary importance and thus in one embodiment the virus according to the present disclosure may be adsorbed or absorbed onto a particle, such as a lactose particle of the given size.

The propellant gases which can be used to prepare the inhalable aerosols are known in the art. Suitable propellant gases are selected from among hydrocarbons such as n-propane, n-butane or isobutane and halohydrocarbons such as chlorinated and/or fluorinated derivatives of methane, ethane, propane, butane, cyclopropane or cyclobutane. The above-mentioned propellant gases may be used on their own or in mixtures thereof.

Particularly suitable propellant gases are halogenated alkane derivatives selected from among TG 11, TG 12, TG 134a and TG227. Of the abovementioned halogenated hydrocarbons, TG134a (1,1,1,2-tetrafluoroethane) and TG227 (1,1,1,2,3,3,3-heptafluoropropane) and mixtures thereof are particularly suitable.

The propellant gas-containing inhalable aerosols may also contain other ingredients, such as co-solvents, stabilisers, surface-active agents (surfactants), antioxidants, lubricants and means for adjusting the pH. All these ingredients are known in the art.

The propellant gas-containing inhalable aerosols according to the invention may contain up to 5% by weight of active substance. Aerosols according to the invention contain, for example, 0.002 to 5% by weight, 0.01 to 3% by weight, 0.015 to 2% by weight, 0.1 to 2% by weight, 0.5 to 2% by weight or 0.5 to 1% by weight of active ingredient.

Alternatively topical administrations to the lung may also be by administration of a liquid solution or suspension formulation, for example employing a device such as a nebulizer, for example, a nebulizer connected to a compressor (e.g., the Pari LC-Jet Plus® nebulizer connected to a Pari Master® compressor manufactured by Pari Respiratory Equipment, Inc., Richmond, Va.).

The virus of the invention can be delivered dispersed in a solvent, e.g. in the form of a solution or a suspension, for example as already described above for parenteral formulations. It can be suspended in an appropriate physiological solution, e.g., saline or other pharmacologically acceptable solvent or a buffered solution. Buffered solutions known in the art may contain 0.05 mg to 0.15 mg disodium edetate, 8.0 mg to 9.0 mg NaCl, 0.15 mg to 0.25 mg polysorbate, 0.25 mg to 0.30 mg anhydrous citric acid, and 0.45 mg to 0.55 mg sodium citrate per 1 ml of water so as to achieve a pH of about 4.0 to 5.0.

The therapeutic suspensions or solution formulations can also contain one or more excipients. Excipients are well known in the art and include buffers (e.g., citrate buffer, phosphate buffer, acetate buffer and bicarbonate buffer), amino acids, urea, alcohols, ascorbic acid, phospholipids, proteins (e.g., serum albumin), EDTA, sodium chloride, liposomes, mannitol, sorbitol, and glycerol. Solutions or suspensions can be encapsulated in liposomes or biodegradable microspheres. The formulation will generally be provided in a substantially sterile form employing sterile manufacture processes.

This may include production and sterilization by filtration of the buffered solvent/solution used for the formulation, aseptic suspension of the antibody in the sterile buffered solvent solution and dispensing of the formulation into sterile receptacles by methods familiar to those of ordinary skill in the art.

Nebulisable formulation according to the present disclosure may be provided, for example, as single dose units (e.g., sealed plastic containers or vials) packed in foil envelopes. Each vial contains a unit dose in a volume, e.g., 2 mL, of solvent/solution buffer.

Treatment

In a further aspect the present disclosure extends to a virus or viral vector or a formulation thereof as described herein for use in treatment, in particular for the treatment of cancer.

In one embodiment the method of treatment is for use in the treatment of a tumour.

Tumour as employed herein is intended to refer to an abnormal mass of tissue that results from excessive cell division that is uncontrolled and progressive, also called a neoplasm. Tumours may be either benign (not cancerous) or malignant. Tumour encompasses all forms of cancer and metastases.

In one embodiment the tumour is a solid tumour. The solid tumour may be localised or metastasised.

In one embodiment the tumour is of epithelial origin.

In one embodiment the tumour is a malignancy, such as colorectal cancer, hepatoma, prostate cancer, pancreatic cancer, breast cancer, ovarian cancer, thyroid cancer, renal cancer, bladder cancer, head and neck cancer or lung cancer.

In one embodiment the tumour is a colorectal malignancy.

Malignancy as employed herein means cancerous cells.

In one embodiment the oncolytic virus or viral vector is employed in the treatment or prevention of metastasis.

In one embodiment the method or formulation herein is employed in the treatment of drug resistant cancers.

In one embodiment the virus or viral vector is administered in combination with the administration of a further cancer treatment or therapy.

In one embodiment there is provided a virus, viral vector or formulation according to the present disclosure for use in the manufacture of a medicament for the treatment of cancer, for example a cancer described above.

In a further aspect there is provide a method of treating cancer comprising administering a therapeutically effective amount of a virus or formulation according to the present disclosure to a patient in need thereof, for example a human patient.

In one embodiment the oncolytic virus or formulation herein is administered in combination with another therapy.

"In combination" as employed herein is intended to encompass where the oncolytic virus or viral vector is administered before, concurrently and/or post cancer treatment or therapy.

Cancer therapy includes surgery, radiation therapy, targeted therapy and/or chemotherapy.

Cancer treatment as employed herein refers to treatment with a therapeutic compound or biological agent, for example an antibody intended to treat the cancer and/or maintenance therapy thereof.

In one embodiment the cancer treatment is selected from any other anti-cancer therapy including a chemotherapeutic agent, a targeted anticancer agent, radiotherapy, radio-isotope therapy or any combination thereof.

In one embodiment the virus or viral vector of the present disclosure ay be used as a pre-treatment to the therapy, such as a surgery (neoadjuvant therapy), to shrink the tumour, to treat metastasis and/or prevent metastasis or further metastasis. The oncolytic virus or viral vector may be used after the therapy, such as a surgery (adjuvant therapy), to treat metastasis and/or prevent metastasis or further metastasis.

Concurrently as employed herein is the administration of the additional cancer treatment at the same time or approximately the same time as the oncolytic virus or viral vector formulation. The treatment may be contained within the same formulation or administered as a separate formulation.

In one embodiment the virus or viral vector is administered in combination with the administration of a chemotherapeutic agent.

Chemotherapeutic agent as employed herein is intended to refer to specific antineoplastic chemical agents or drugs that are selectively destructive to malignant cells and tissues. For example, alkylating agents, antimetabolites, anthracyclines, plant alkaloids, topoisomerase inhibitors, and other antitumour agents. Other examples of chemotherapy include doxorubicin, 5-fluorouracil (5-FU), paclitaxel, capecitabine, irinotecan, and platins such as cisplatin and oxaliplatin. The preferred dose may be chosen by the practitioner based on the nature of the cancer being treated.

In one embodiment the therapeutic agent is ganciclovir, which may assist in controlling immune responses and/or tumour vascularisation.

In one embodiment the therapeutic agent is a check-point inhibitor, such as PD-1 inhibitor, a PD-L1 inhibitor, in particular wherein the inhibitor is a monoclonal antibody or antibody fragment.

In one embodiment one or more therapies employed in the method herein are metronomic, that is a continuous or frequent treatment with low doses of anticancer drugs, often given concomitant with other methods of therapy.

Subgroup B oncolytic adenoviruses, in particular Ad11 and those derived therefrom such as EnAd may be particularly synergistic with chemotherapeutics because they seem to have a mechanism of action that is largely independent of apoptosis, killing cancer cells by a predominantly necrolytic mechanism. Moreover, the immunosuppression that occurs during chemotherapy may allow the oncolytic virus to function with greater efficiency.

Therapeutic dose as employed herein refers to the amount of virus or viral vector that is suitable for achieving the intended therapeutic effect when employed in a suitable treatment regimen, for example ameliorates symptoms or conditions of a disease. A dose may be considered a therapeutic dose in the treatment of cancer or metastases when the number of viral particles may be sufficient to result in the following: tumour or metastatic growth is slowed or stopped, or the tumour or metastasis is found to shrink in size, and/or the life span of the patient is extended. Suitable therapeutic doses are generally a balance between therapeutic effect and tolerable toxicity, for example where the side-effect and toxicity are tolerable given the benefit achieved by the therapy.

In one embodiment there is provided systemically administering multiple doses of a parenteral formulation of an oncolytic adenovirus according to the present disclosure in a single treatment cycle, for example wherein the total dose given in each administration is in the range of $1 \times 10^{10}$ to $1 \times 10^{14}$ viral particles per dose.

In one embodiment one or more doses (for example each dose) of virus or viral vector is administered such that the rate of viral particle delivery is in the range of $2 \times 10^{10}$ particles per minute to $2 \times 10^{12}$ particles per minute.

In one embodiment a virus or therapeutic construct according to the present disclosure (including a formulation comprising same) is administered weekly, for example one week 1 the dose is administered on day 1, 3, 5, followed by one dose each subsequent week.

In one embodiment a virus or therapeutic construct according to the present disclosure (including a formulation comprising same) is administered bi-weekly or tri-weekly, for example is administered in week 1 one on days 1, 3 and 5, and on week 2 or 3 is also administered on days 1, 3 and 5 thereof. This dosing regimen may be repeated as many times as appropriate.

In one embodiment a virus or therapeutic construct according to the present disclosure (including a formulation comprising same) is administered monthly.

In one embodiment the viruses, viral vectors and constructs of the present disclosure are prepared by recombinant techniques. The skilled person will appreciate that the armed virus or viral vector genome can be manufactured by other technical means, including entirely synthesising the genome or a plasmid comprising part of all of the genome. The skilled person will appreciate that in the event of synthesising the genome the region of insertion may not comprise the restriction site nucleotides as the latter are artefacts following insertion of genes using cloning methods.

In one embodiment the armed virus or viral vector genome is entirely synthetically manufactured, The disclosure herein further extends to a virus of formula (I) or a subformula thereof, obtained or obtainable from inserting a transgene or transgene cassette.

"Is" as employed herein means comprising.

In the context of this specification "comprising" is to be interpreted as "including".

Embodiments of the invention comprising certain features/elements are also intended to extend to alternative embodiments "consisting" or "consisting essentially" of the relevant elements/features.

Where technically appropriate, embodiments of the invention may be combined. Technical references such as patents and applications are incorporated herein by reference.

Any embodiments specifically and explicitly recited herein may form the basis of a disclaimer either alone or in combination with one or more further embodiments.

The present invention is further described by way of illustration only in the following examples.

EXAMPLES

Example 1: Production of EnAd Viruses Expressing the T Cell Activating Antigen CD80 and a Membrane-anchored Single Chain Fv Fragment Antibody to the ε Chain of the Human CD3 Complex (CD3ε)

Figure 2A:
FIG. 2 shows schematics of transgene cassettes for viruses expressing human CD80 (FIG. 2A), co-expressing human IFNα and human CD80 (FIG. 2B), co-expressing OKT3 scFv and human CD80 (FIG. 2C), co-expressing human Flt3L, human MIP1α and human IFNα (FIG. 2D), co-expressing human Flt3L, human MIP1α and human CD80 (FIG. 2E), co-expressing human IFNα, human MIP1α and human CD80 (FIG. 2F), and a schematic of the open reading frame (ORF) or the OKT3 scFv (FIG. 2G)
Figure 2B:
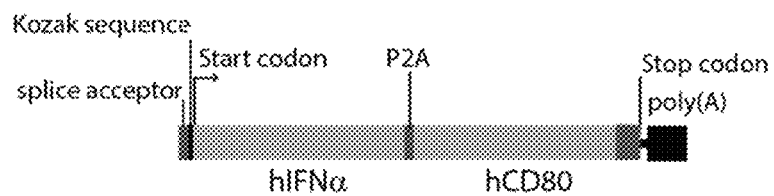
Figure 2C:
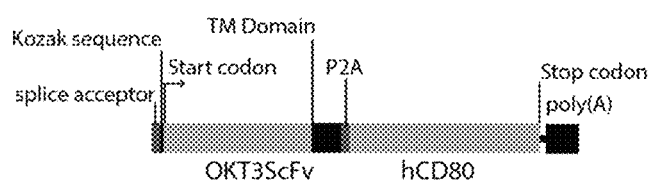

The plasmid pEnAd2.4 was used to generate the plasmids pNG-348 by direct insertion of a cassette encoding the human T cell activating antigen CD80 (SEQ ID NO 98) and a membrane-anchored chimeric form of the single chain Fv anti-human CD3e (SEQ ID NO 4). The pNG-348 cassette contains; a 5' short splice acceptor sequence (CAGG); membrane-anchored anti-human CD3e ScFv cDNA; a high efficiency self-cleavable P2A peptide sequence (SEQ ID NO. 94); human CD80 cDNA sequence and a 3' polyadenylation sequence (SEQ ID NO. 99. A Schematic of the inserted transgene cassette is shown in FIG. 2C. Construction of the plasmid is confirmed by DNA sequencing.

Virus Production and Characterisation

The plasmid pNG-348 is linearised by restriction digest with the enzyme AscI to produce the virus genome NG-348 (SEQ ID NO: 100). The virus NG-348 is amplified and purified according to methods given below.

Digested DNA was purified by phenol/chloroform extraction and precipitated for 16 hrs, −20° C. in 300 μl >95% molecular biology grade ethanol and 10 μl 3M Sodium Acetate. The precipitated DNA was pelleted by centrifuging at 14000 rpm, 5 mins and was washed in 500 μl 70% ethanol, before centrifuging again, 14000 rpm, 5 mins. The clean DNA pellet was air dried, resuspended in 500 μl OptiMEM containing 15 μl lipofectamine transfection reagent and incubated for 30 mins, RT. The transfection mixture was then added drop wise to a T-25 flask containing 293 cells grown to 70% confluency. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$.

The transfected 293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from 293 cells by three freeze-thaw cycles. The harvested viruses were used to re-infect 293 cells in order to amplify the virus stocks. Viable virus production during amplification was confirmed by observation of significant CPE in the cell monolayer. Once CPE was observed the virus was harvested from 293 cells by three freeze-thaw cycles. The amplified stock was used for further amplification before the virus was purified by double caesium chloride banding to produce a NG-330 virus stock.

Example 2: Production of EnAd Viruses Expressing the T Cell Activating Antigen CD80 and a Membrane-anchored Single Chain Fv Fragment Antibody to the ε Chain of the Human CD3 Complex (CD3ε)

Figure 26:
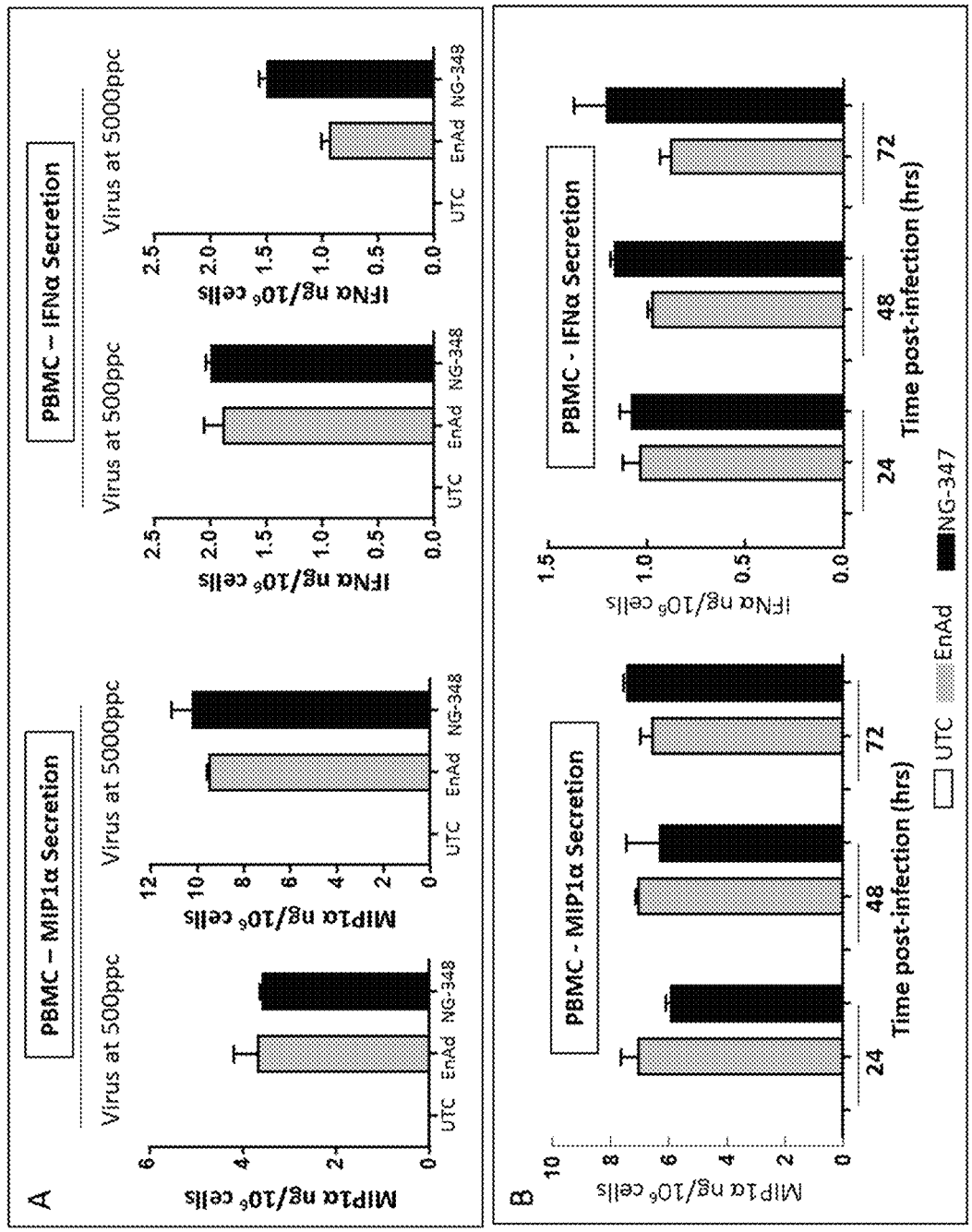
FIG. 26 shows similar particle-mediated MIP1α and IFNα protein secretion from PBMCs cultured with NG-348 (A) or NG-347 (B) compared to EnAd.
Figure 27:
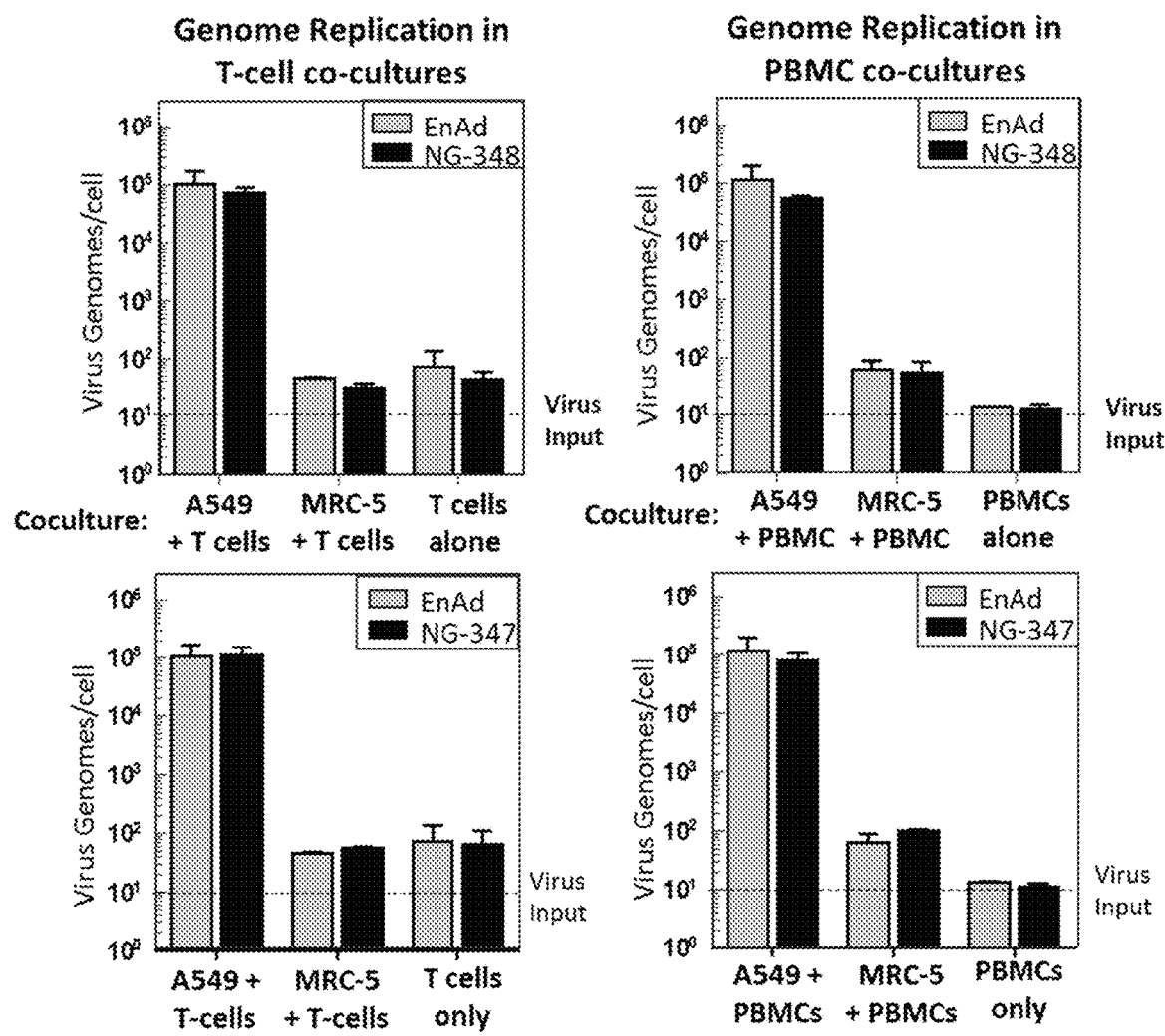
FIG. 27 shows NG-347 or NG-348 genome replication in co-cultures or T-cells or PBMCs with MRC-5 fibroblast cells compared to co-cultures with A549 tumour cells

The plasmid pEnAd2.4 was used to generate the plasmids pNG-348A by direct insertion of a cassette encoding the human T cell activating antigen CD80 (SEQ ID NO 98) and a membrane-anchored chimeric form of the single chain Fv anti-human CD3e with a C-terminal V5 tag (SEQ ID NO: 5). The pNG-348 cassette contains; a 5' short splice acceptor sequence (CAGG); membrane-anchored anti-human CD3e ScFv cDNA; a C-terminal V5 tag (SEQ ID NO: 101); a high efficiency self-cleavable P2A peptide sequence (SEQ ID NO: 94); human CD80 cDNA sequence and a 3' polyadenylation sequence (SEQ ID NO: 99). A Schematic of the NG-348A transgene cassettes is shown in FIG. 26A. Construction of the plasmid is confirmed by DNA sequencing.

Virus Production and Characterisation

The plasmid pNG-348A is linearised by restriction digest with the enzyme AscI to produce the virus genome NG-348A (SEQ ID NO: 102). The virus NG-348A is amplified and purified according to methods detailed in Example 1.

Example 3: Production of EnAd Viruses Expressing a Membrane-Anchored Single Chain Fv Fragment Antibody to the ε Chain of the Human CD3 Complex (CD3ε)

The plasmid pEnAd2.4 was used to generate the plasmids pNG-420 and pNG-420A by direct insertion of a cassettes encoding a membrane-anchored chimeric form of the single chain Fv anti-human CD3e with a C-terminal V5 tag (SEQ ID NO: 5) or without a V5 tag (SEQ ID NO: 4). The pNG-420 cassette contains; a 5' short splice acceptor sequence (CAGG); membrane-anchored anti-human CD3e ScFv cDNA and a 3' polyadenylation sequence (SEQ ID NO: 99). The pNG-420A cassette contains; a 5' short splice acceptor sequence (CAGG); membrane-anchored anti-human CD3e ScFv cDNA; a C-terminal V5 tag (SEQ ID NO: 101) and a 3' polyadenylation sequence (SEQ ID NO: 99). Schematics of the NG-420 and NG-420A transgene cassettes are shown in FIGS. 3B and 3C. Construction of each plasmid is confirmed by DNA sequencing.

Virus Production and Characterisation

The plasmids pNG-420 and pNG-420A are linearised by restriction digest with the enzyme AscI to produce the virus genomes NG-420 (SEQ ID NO: 103) and NG-420A (SEQ ID NO: 104). The viruses NG-420 and NG-420A are amplified and purified according to methods detailed in Example 1.

Figure 43:
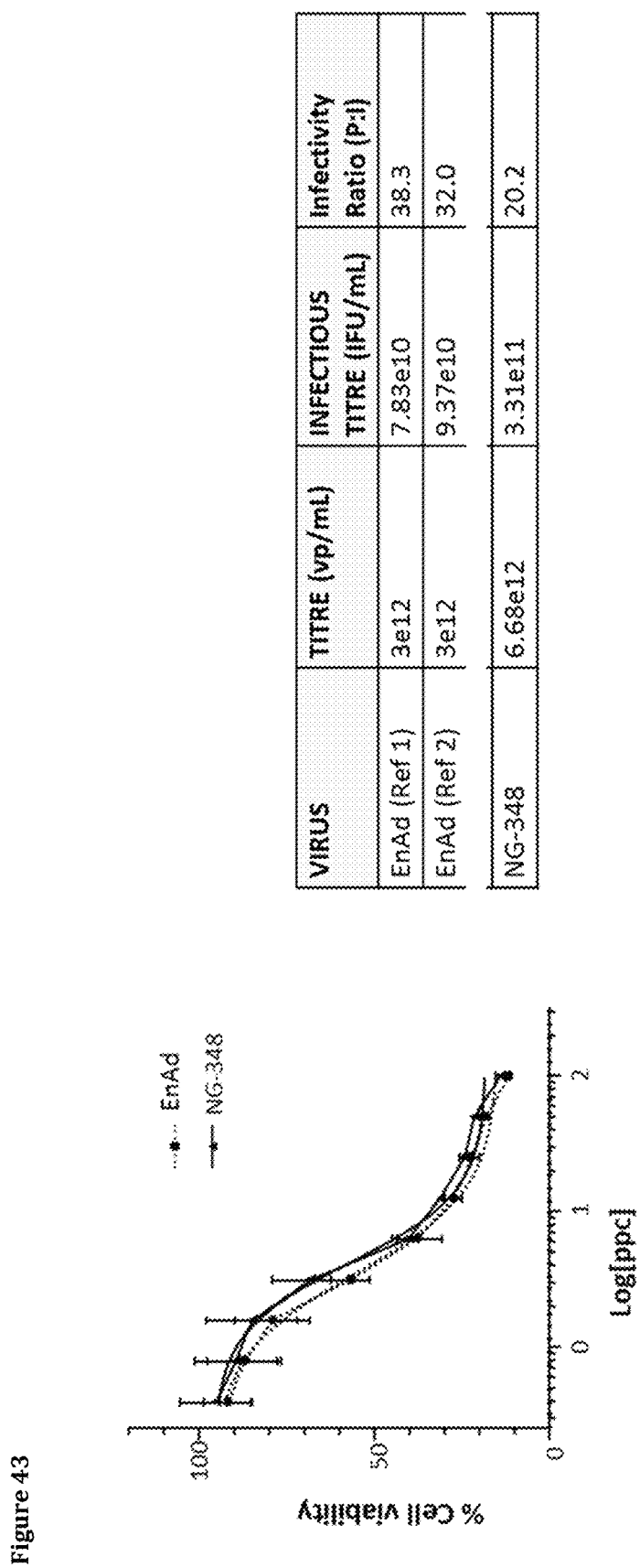
FIG. 43 shows comparable oncolytic potency (FIG. 43) and infectivity (FIG. 43 table) of EnAd, and NG-348 viruses in an HT-29 cytotoxicity assay
Figure 46A:
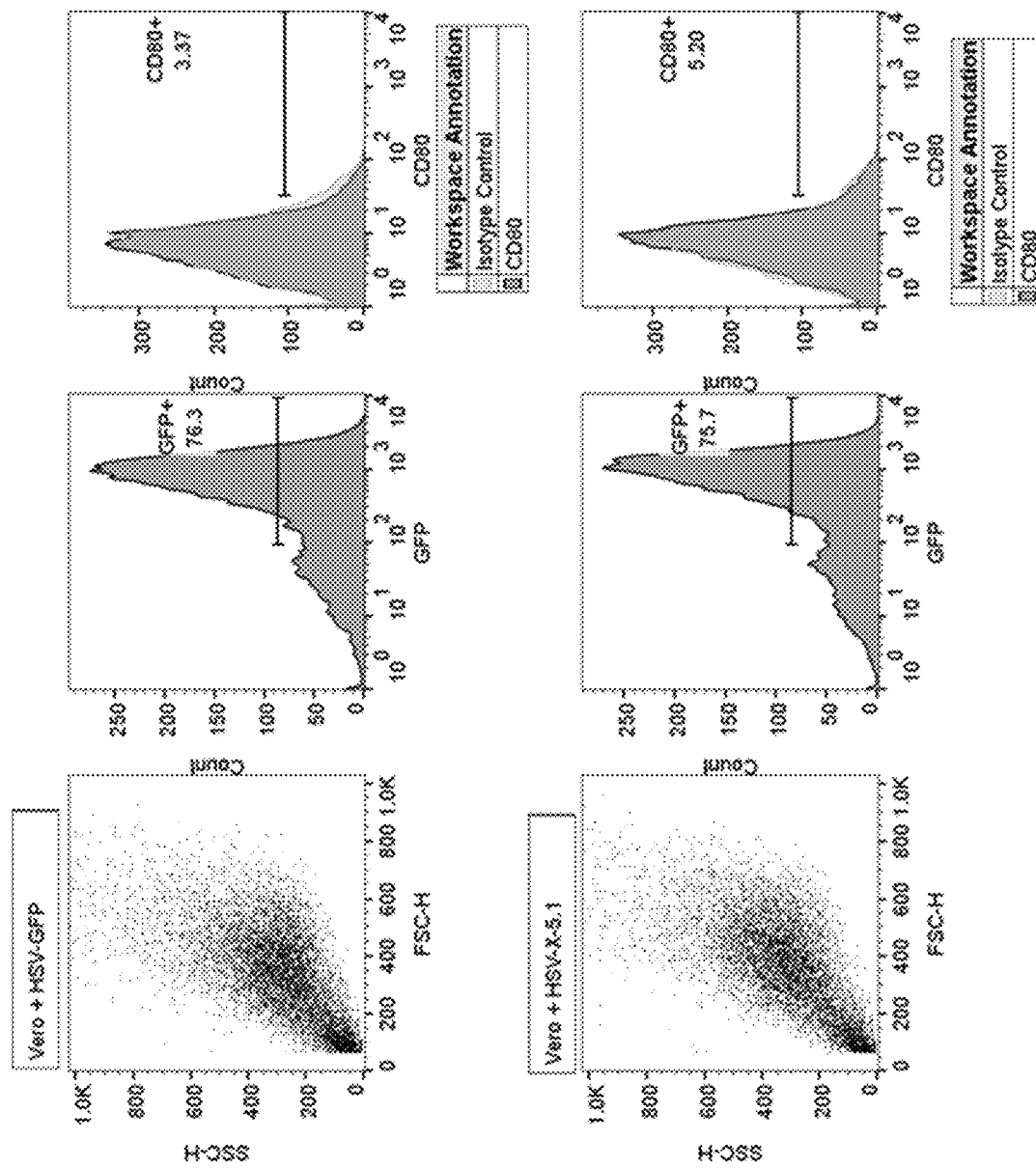
FIGS. 46 F-H show transgene expression and T cell activation upon infection of Vero cells by HSV-X. T cell activation was only observed upon stimulation with cells infected with HSV-X-8.1, which confirms functional expression of the transgene.
Figure 46A:
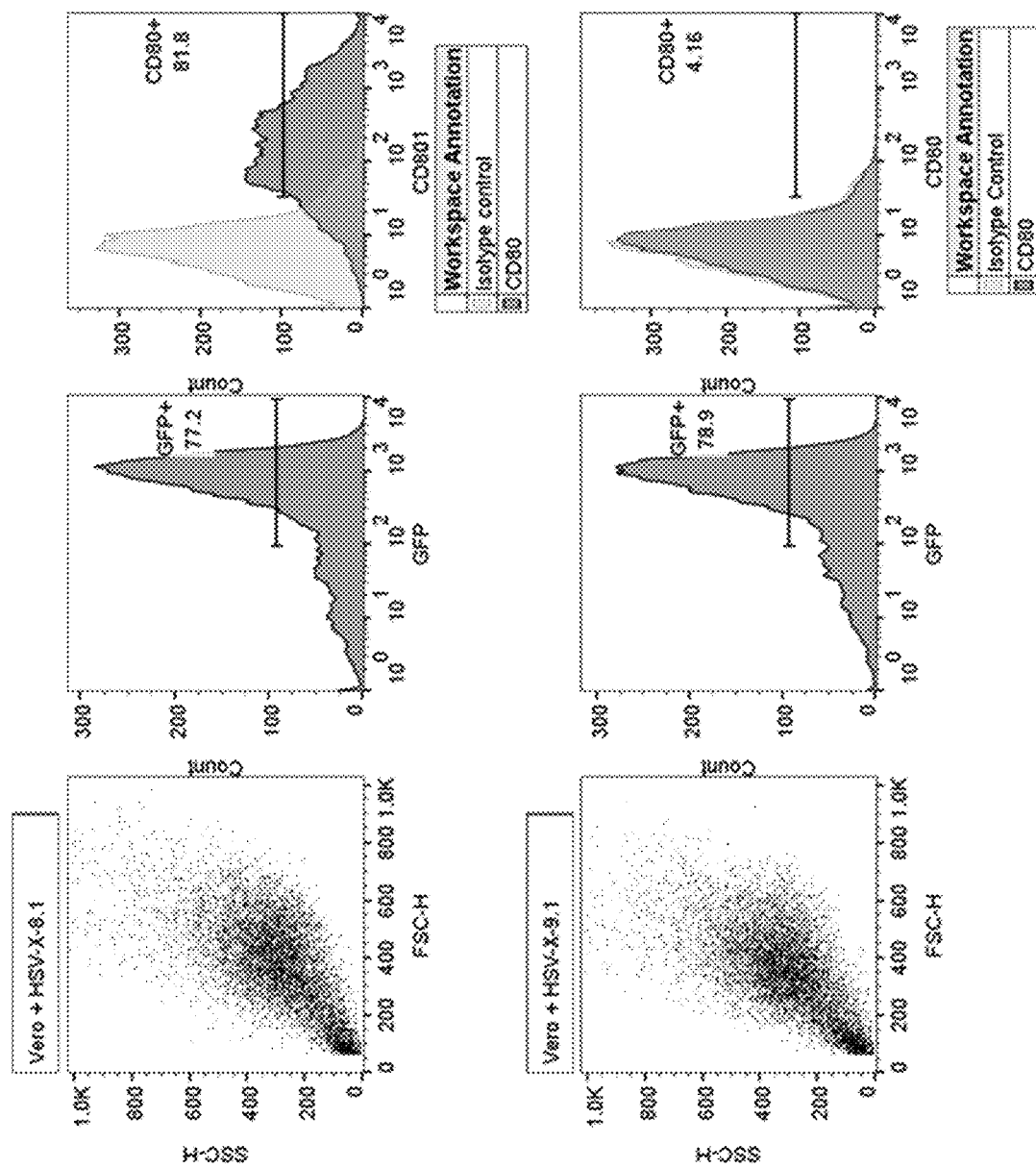
Figure 46A:
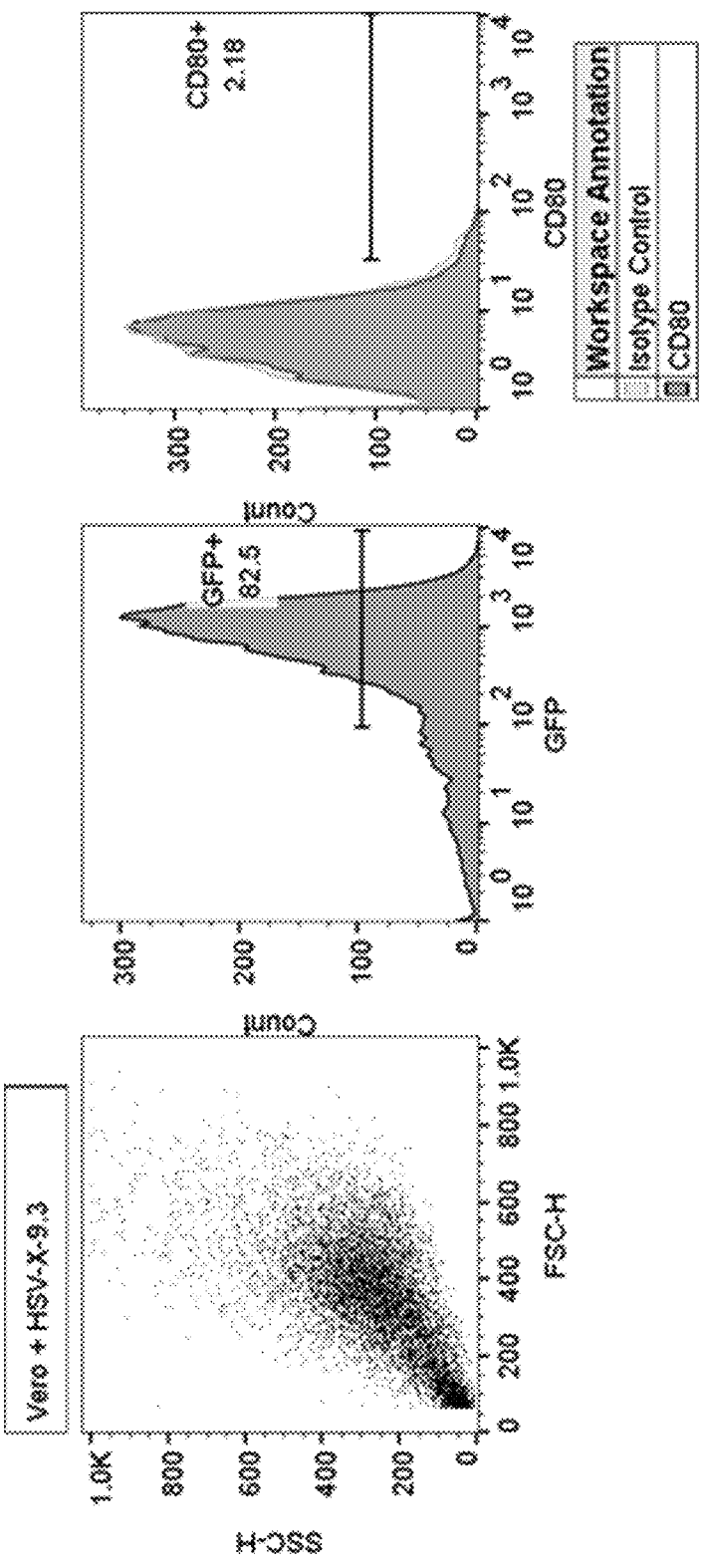
Figure 46F:
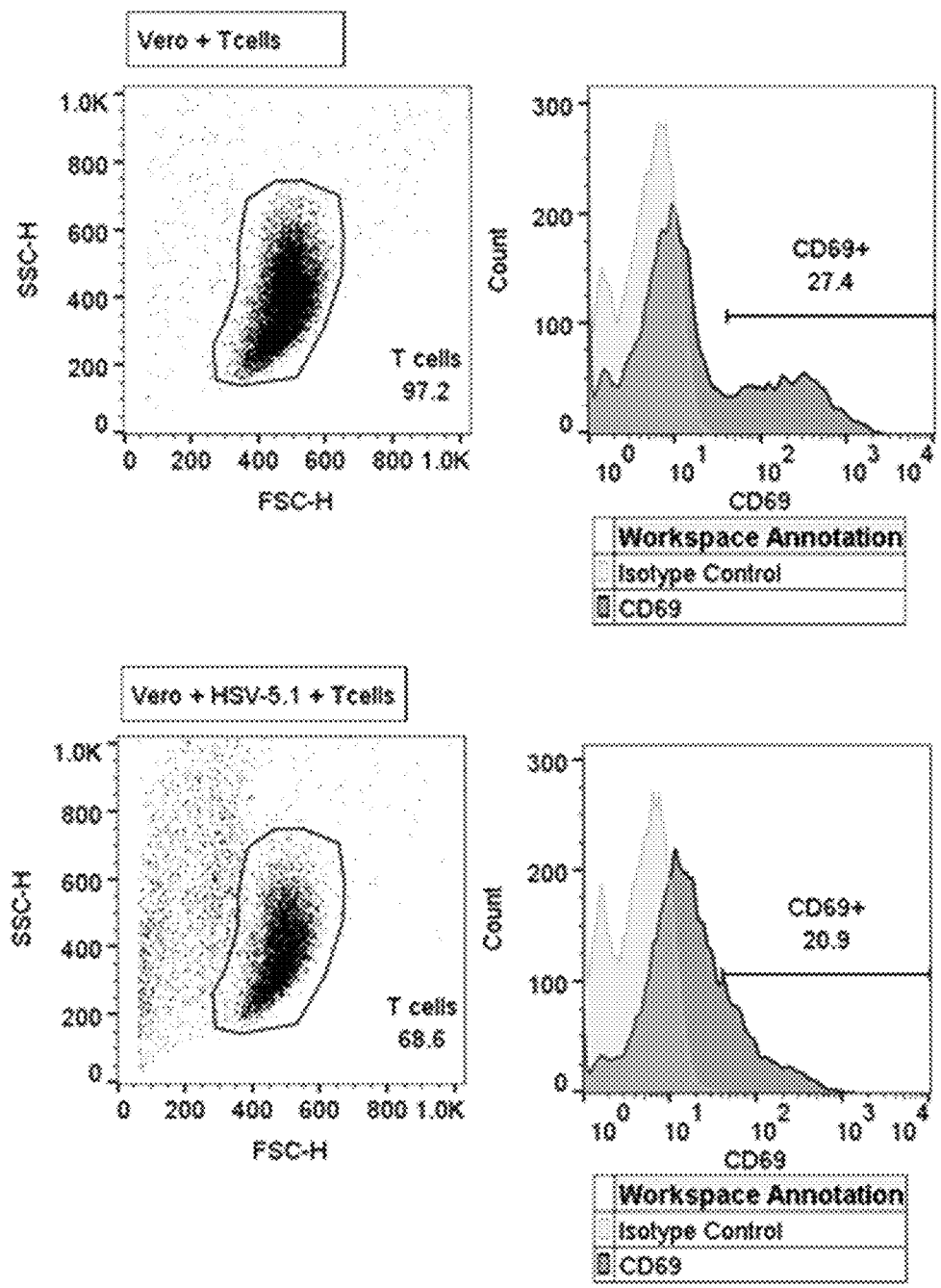
Figure 46F:
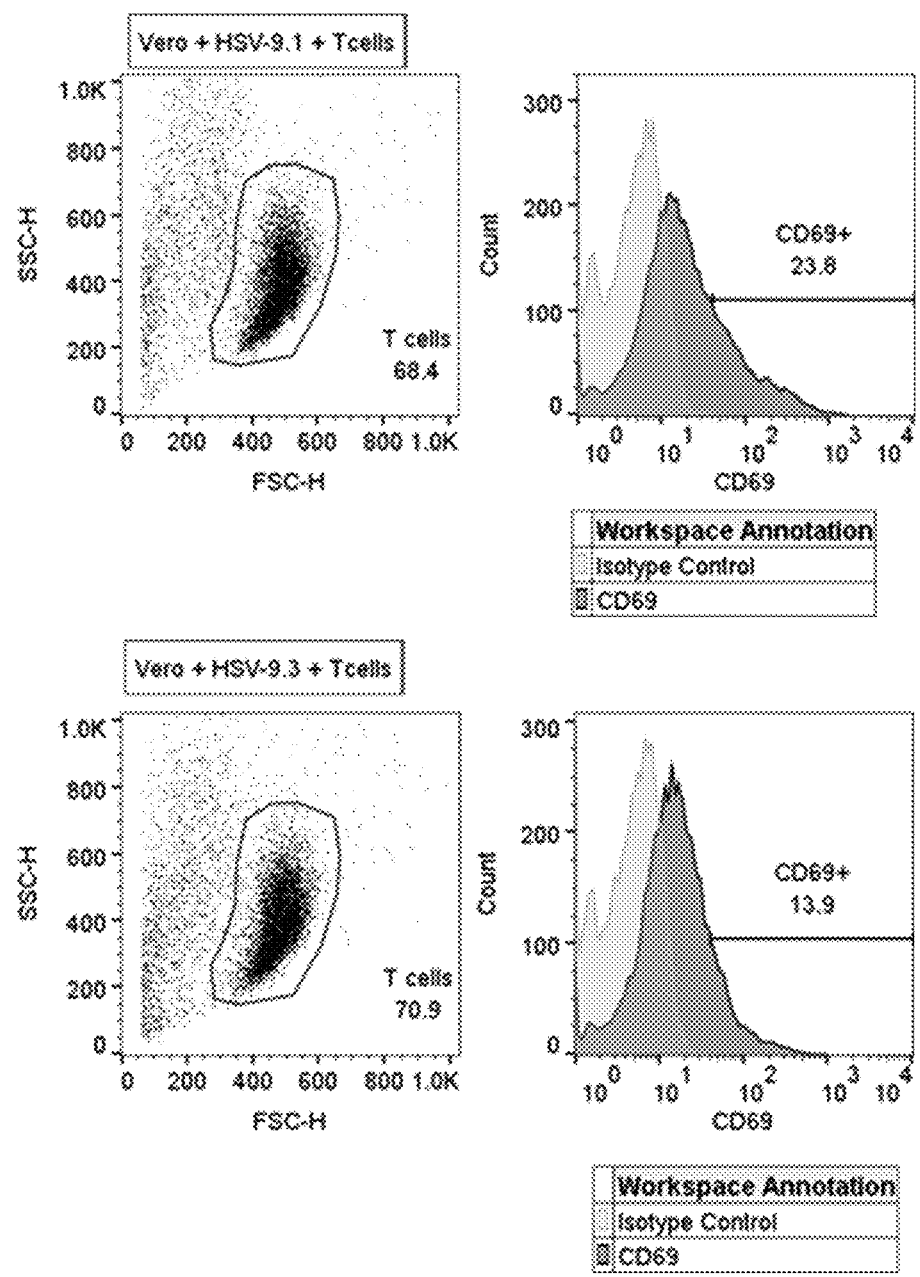
Figure 46G:
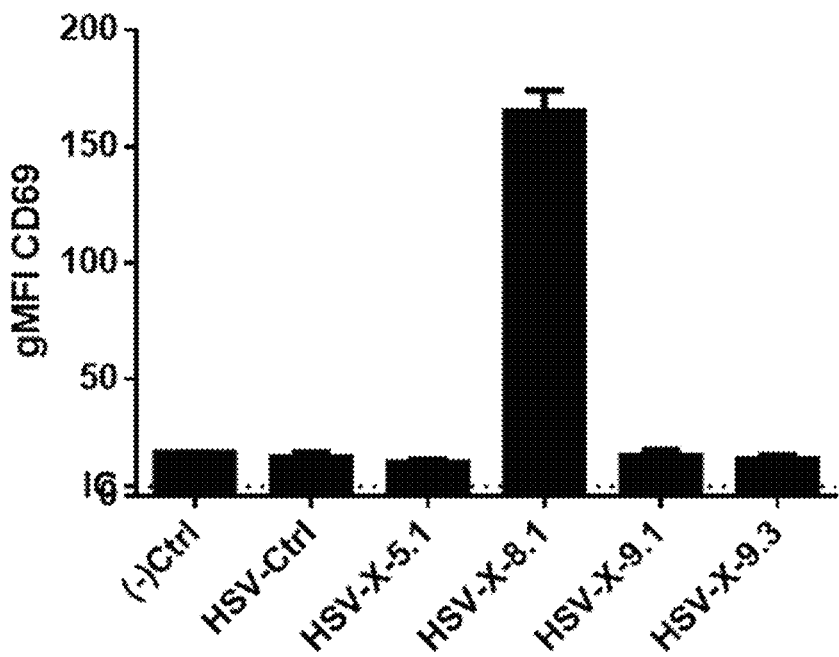
Figure 46H:
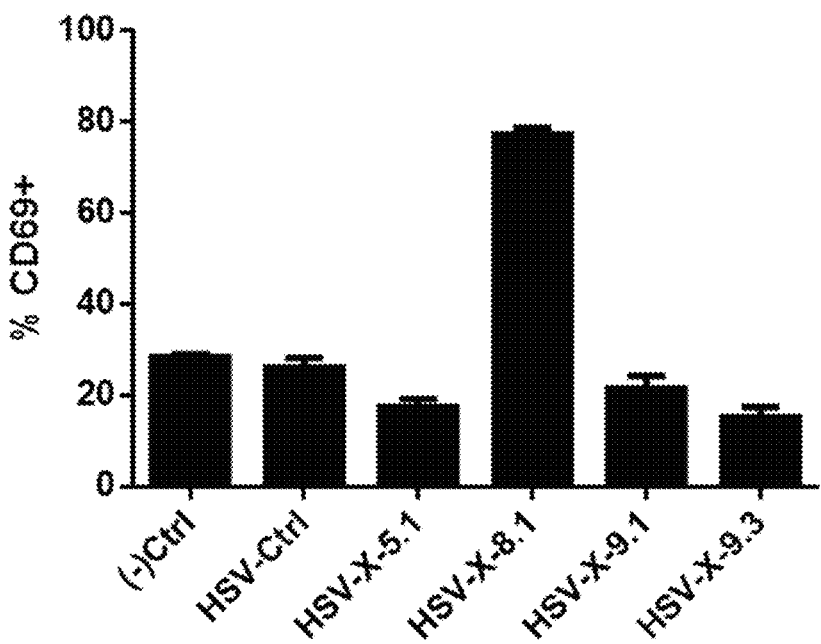

Example 4: Oncolytic Activity and Infectivity of NG-347 and NG-348 Viruses in Colon Carcinoma Cells Virus Oncolytic Potency HT-29 colon carcinoma cells were seeded in 96 well plates at a cell density of 2.5e4 cells/well. Plates were incubated for 4 hrs, 37° C., 5% $CO_2$, before cells were either infected with EnAd, NG-347 or NG-348 virus particles at an infection density range of 100-0.39 particles per cell (ppc). HT-29 cell viability was assessed using Cell Titre 96 MTS Reagent (Promega: G3581) 72 hrs post infection. Quantification of the % cell survival at each infection density demonstrated that NG-348 oncolytic potency was comparable to EnAd (FIG. 43).

Viral Particle Infectivity

HT-29 colon carcinoma cells were seeded in 12 well plates at a cell density of 4e5 cells/well. Plates were incubated for 24 hrs, 37° C., 5% $CO_2$, before cells were either infected with EnAd, NG-347 or NG-348 virus particles at an infection density range of 1.6e7-2e6 vp/mL. Infection of HT-29 cells was detected by antibody staining of the virus protein hexon. Stained cells were quantified by manual counting of 6 fields of view per well, across 6 replicate wells for each dilution tested. The particle to infectivity ratio (P:I) was calculated for each virus from the viral titre and demonstrated NG-348 has similar infectivity ratios to EnAd reference controls (FIG. 43 Table).

Example 5: Cell Surface Expression of the T Cell Activating Antigen, CD80, in NG-347 and NG-348 Infected Carcinoma Cell Lines CD80 transgene expression (assessed by flow cytometry) was compared in NG-348 and EnAd treated colon carcinoma cell line, DLD-1 or lung carcinoma cell line, A549. A549 or DLD-1 carcinoma cell lines were seeded in 12 well plates at cell densities of 7.5e5 cells/well. Plates were incubated for 18 hrs, 37° C., 5% $CO_2$, before cells were either infected with, 10 EnAd, NG-348 virus particles per cell (ppc) or were left uninfected. CD80 protein expression was compared on the surface of A549 or DLD-1 cells at 24, 48, 72 or 96 hrs post-infection. At each time point cells were harvested and stained according to methods detailed below.

For CD80 cell surface expression, cells were then either incubated at 5° C. for 1 hr with buffer, mouse isotype control antibody conjugated to Cy5 or anti-human CD80 antibody conjugated to Cy5 (clone 2D10). All samples were also co-stained with Zombie Aqua live/dead to differentiate viable cells. Samples were washed 3 times with 1% BSA/PBS before analysis by flow cytometry (FACS, Attune) for cell viability and CD80 protein expression on the cell surface. In keeping with the IFNα expression data, CD80 expression could only be detected on HT-29 cells, with no detectable expression on either the fibroblast or bronchial epithelial cell lines.

Figure 4A:
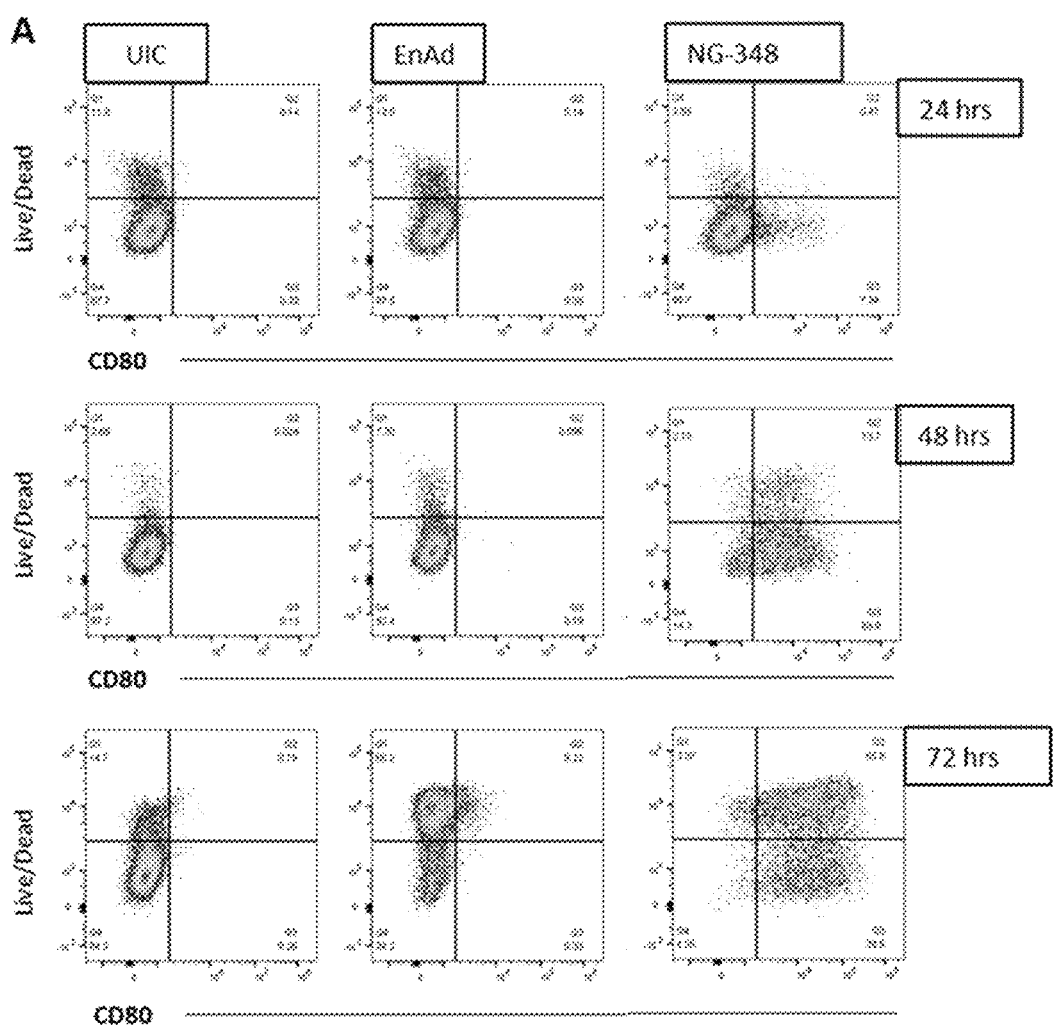
FIG. 4 shows high CD80 expression by 48 hours on the cell surface of A549 tumour cells infected with either NG-347 or NG-348 viruses but little or no CD80 expression following EnAd infection
Figure 4B:
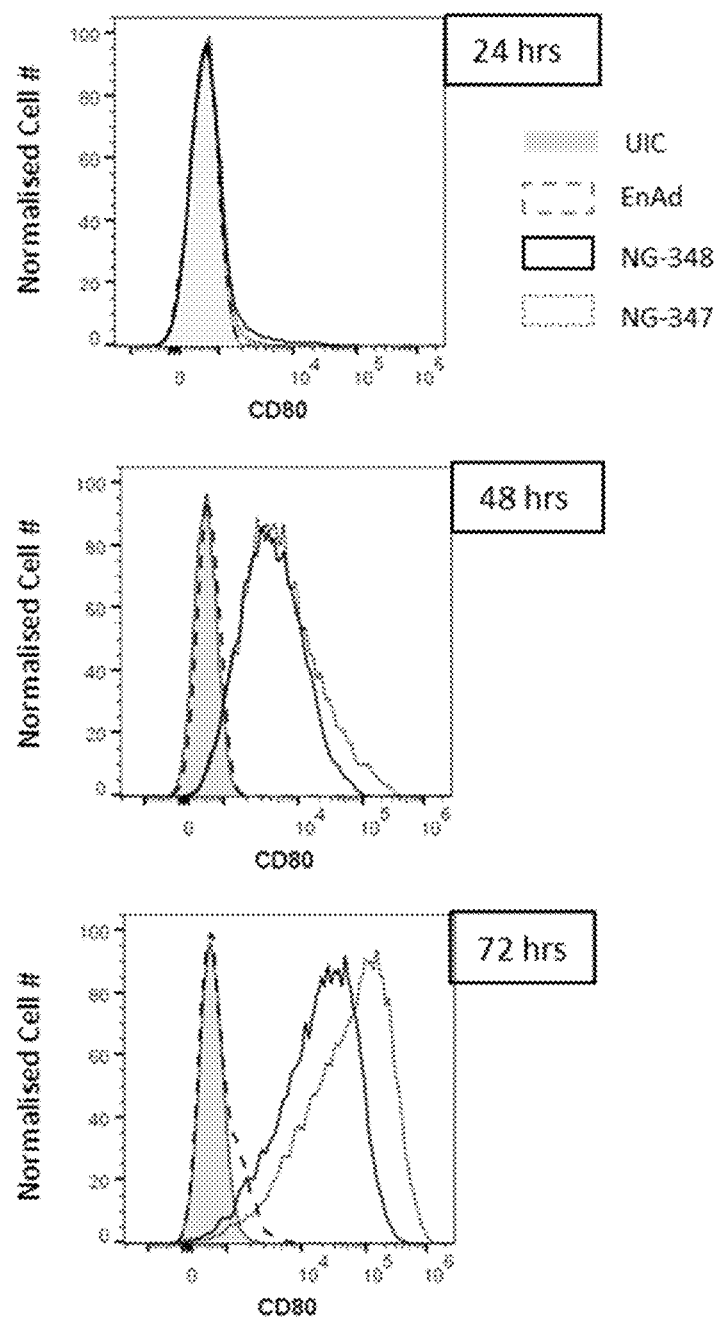
Figure 5A:
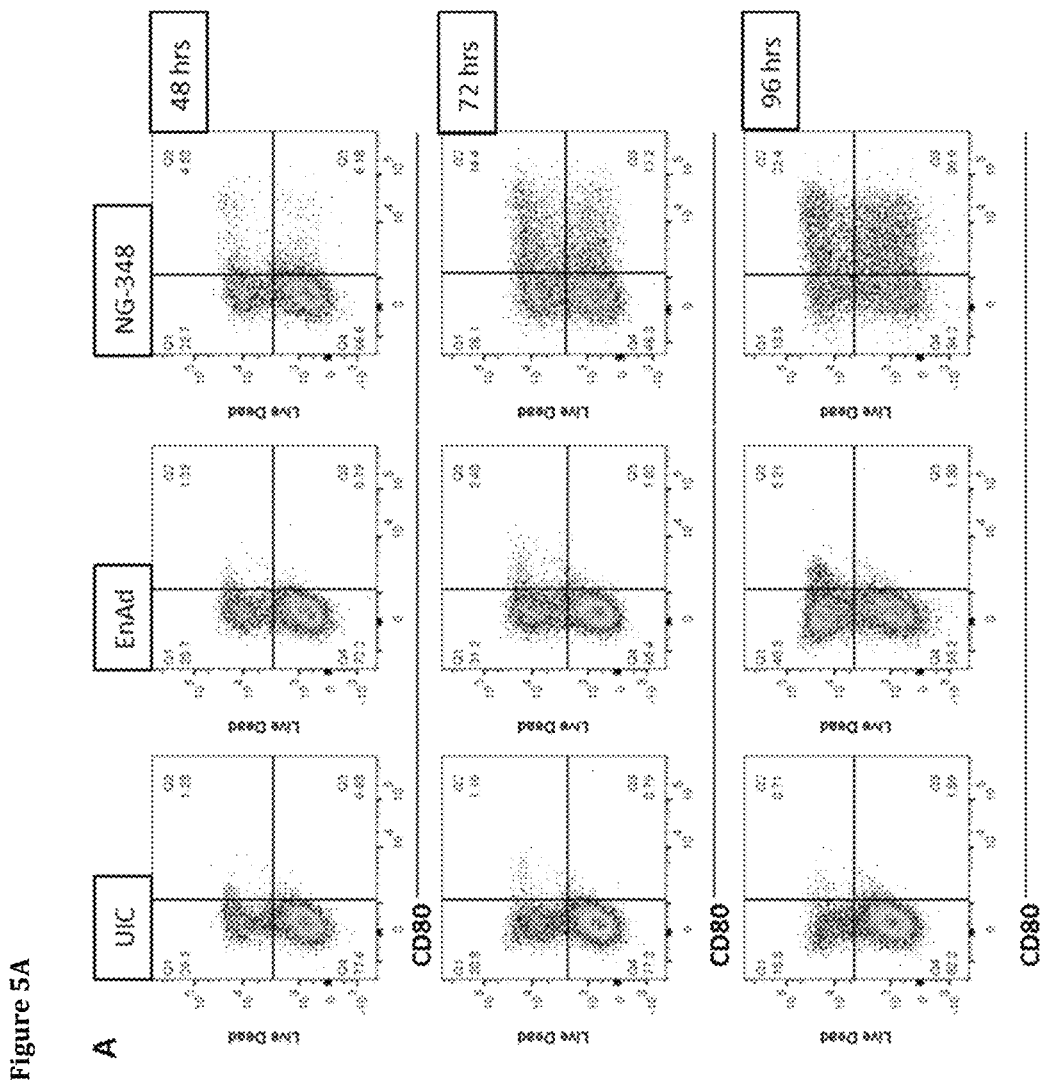
FIG. 5 shows high CD80 expression by 48 hours on the cell surface of DLD-1 tumour cells infected with NG-348 viruses but little or no CD80 expression following EnAd infection
Figure 5B:
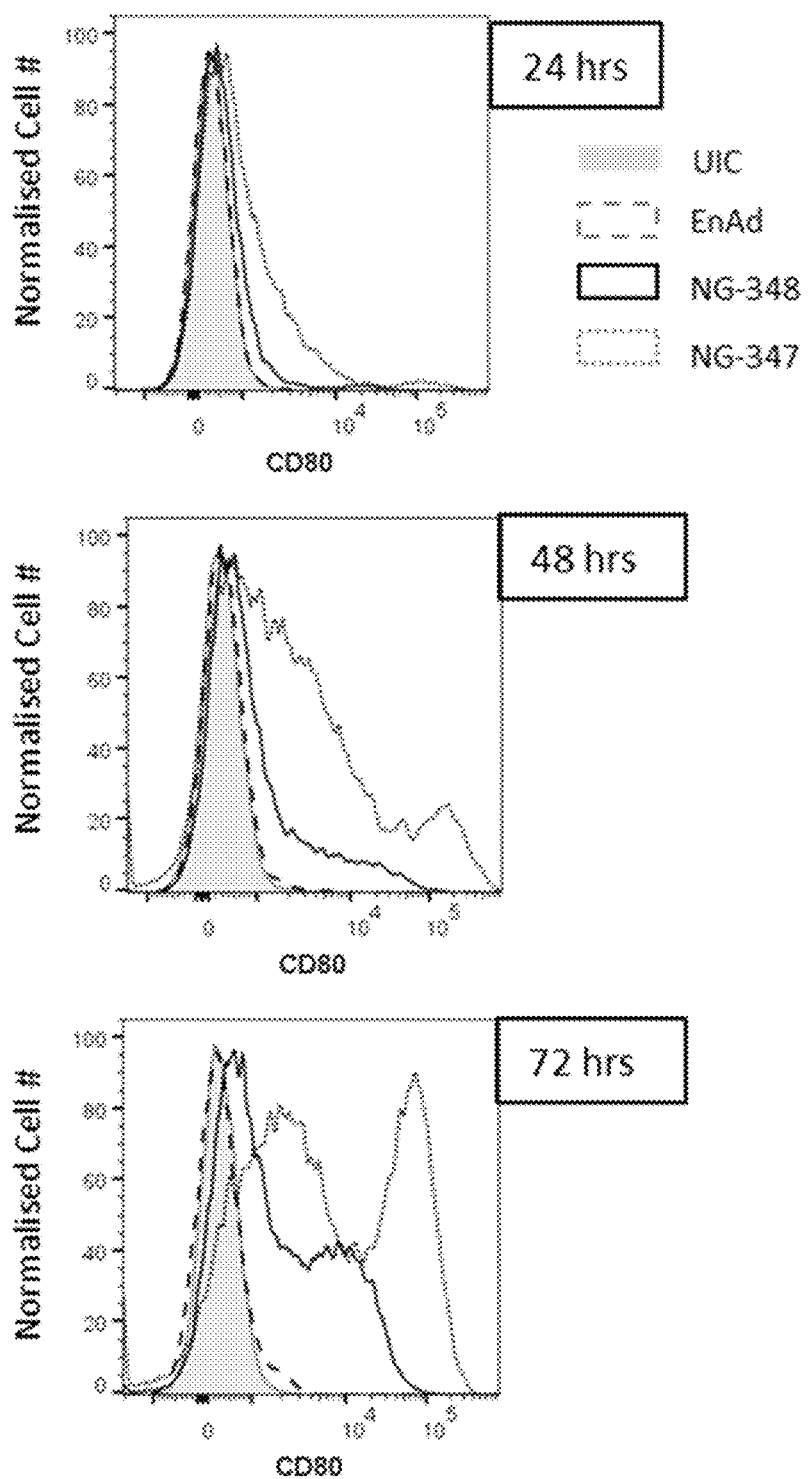

Cells were analysed for cell viability and CD80 protein expression at the cell surface by flow cytometry. Analysis of CD80 expression at 72 hrs post infection in A549 cells showed CD80 could be detected on the surface of >95% of NG-348 treated cells (FIGS. 4A and 4B). At 96 hrs post infection the virus treatments had lysed the majority of A549 cells therefore FACs analysis was not carried out. For DLD-1 cells expression could be detected on >50% of cells by 96 hrs post-treatment with NG-348 (FIGS. 5A and 5B). Staining was not detected on EnAd or untreated controls.

Example 6: T Cell Activation and Degranulation Mediated by NG-348 Infected Carcinoma Cell Lines A549 lung carcinoma cells, either infected with NG-348 or EnAd virus particles or left uninfected, were co-cultured with T cells isolated from human PBMC donors. The selectivity of expression of NG-348 virus encoded CD80 was assessed on the surface of both A549 and T cells by flow cytometry. T cell activation was assessed by analysing cell surface activation markers (by Flow cytometry), CD107a cell surface expression as a marker for degranulation (by Flow cytometry) and secretion of stimulatory cytokines, IL-2 and IFNγ (by ELISA).

A549 cells were seeded into 12 well plates at a density of 5e5 cells/well. Plates were incubated for 18 hrs, 37° C., 5% $CO_2$, before cells were either infected with 10 EnAd or NG-348 virus particles per cell (ppc) or were left uninfected. At 48 hrs post-infection $CD3^+$ T cells, isolated by negative selection from PBMCs (MACs) were added to the A549 cell monolayers at a ratio of 8 T cells:1 tumour cell. The co-culture was carried out for 16 hrs, after which point cellular supernatants were collected for ELISA analysis and tumour cells and T cells harvested for Flow cytometry analysis. Culture media containing non-adherent cells was removed from co-culture wells and centrifuged (300×g). The supernatant was carefully removed, diluted 1 in 2 with PBS 5% BSA and stored for ELISA analysis. The adherent cell monolayers were washed once with PBS and then detached using trypsin. The trypsin was inactivated using complete media and the cells were added to the cell pellets that had been collected from the culture supernatants. The cells were centrifuged (300×g), the supernatant discarded and the cell pellet washed in 200 μl of PBS. The cells were centrifuged again then resuspended in 50 μl of FACs buffer (5% BSA PBS) containing Live/Dead Aqua (Life tech) for 15 minutes at RT. The cells were washed once in FACs buffer before staining with panels of directly conjugated antibodies: anti-CD3 conjugated to BV605; anti-CD25 conjugated to BV421; anti-CD107a conjugated to FITC; anti-EpCam conjugated to PE or anti-CD4 conjugated to PE; and either anti-CD80 conjugated to PE/Cy5 or anti-HLA-DR conjugated to PE/Cy5. A sample of cells from each co-culture condition was also stained with relevant isotype control antibodies. All staining was carried out in FACs buffer in a total volume of 50 μL/well for 15 minutes, 4° C. Cells were then washed with FACs buffer (200 μL) before resuspension in 200 μL of FACs buffer and analysis by Flow cytometry (Attune).

Selective Expression of CD80

Figure 6:
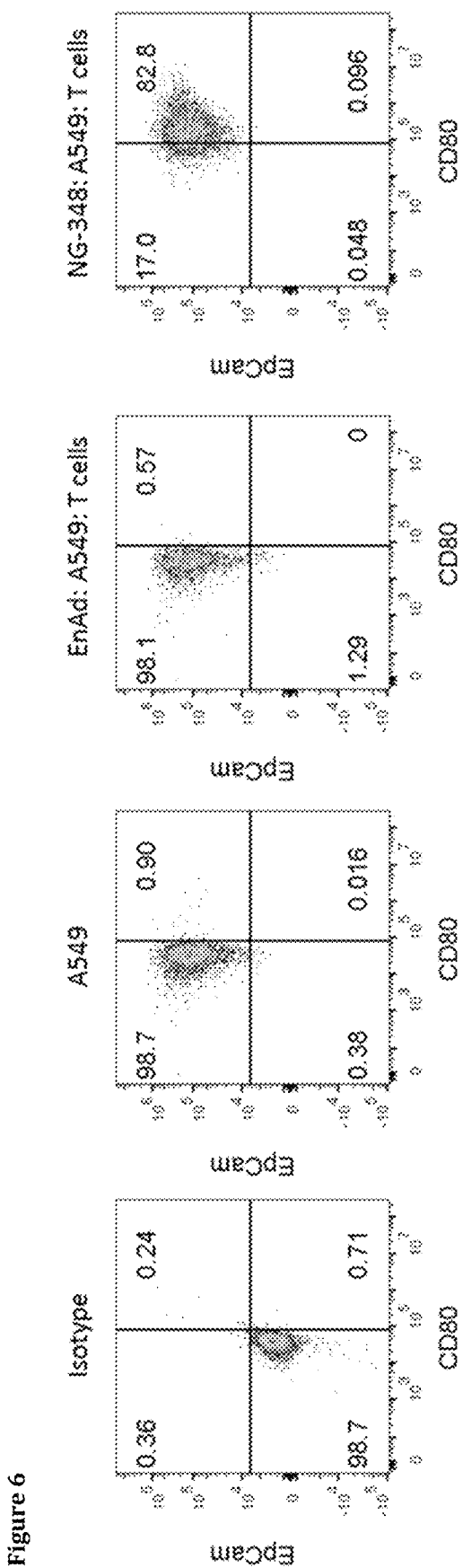
FIG. 6 shows CD80 expression on EpCam$^+$ A549 cells infected with NG-348 and co-cultured with human CD3$^+$ T-cells, but not when infection was with EnAd

Similar to results shown in example 14, CD80 expression was detectable at the surface of >80% of NG-348 infected $EpCam^+$ A549 cells but not EnAd infected or uninfected control cells (FIG. 6). In contrast CD3$^+$ T cells showed no detectable expression of CD80 at the cell surface indicating, at least under these experimental conditions, transgene expression is selective for tumour cells in the co-culture.

Upregulation of T Cell Activation Markers

Figure 8:
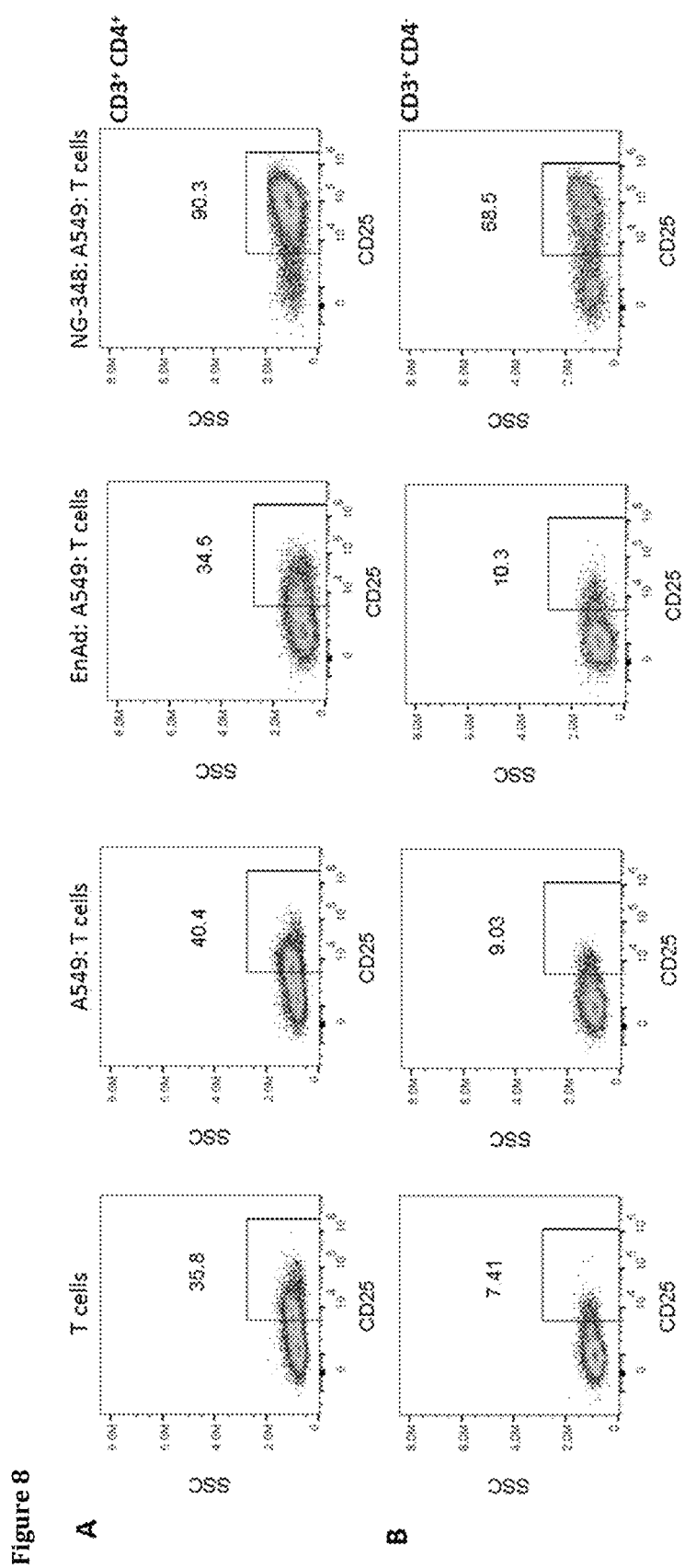
FIG. 8 shows CD25 is upregulated on both CD4$^+$ and CD4$^-$ (primarily CD8) human CD3$^+$ T cell subsets following co-culture with NG-348 infected A549 cells, but not when infection was with EnAd.
Figure 8:
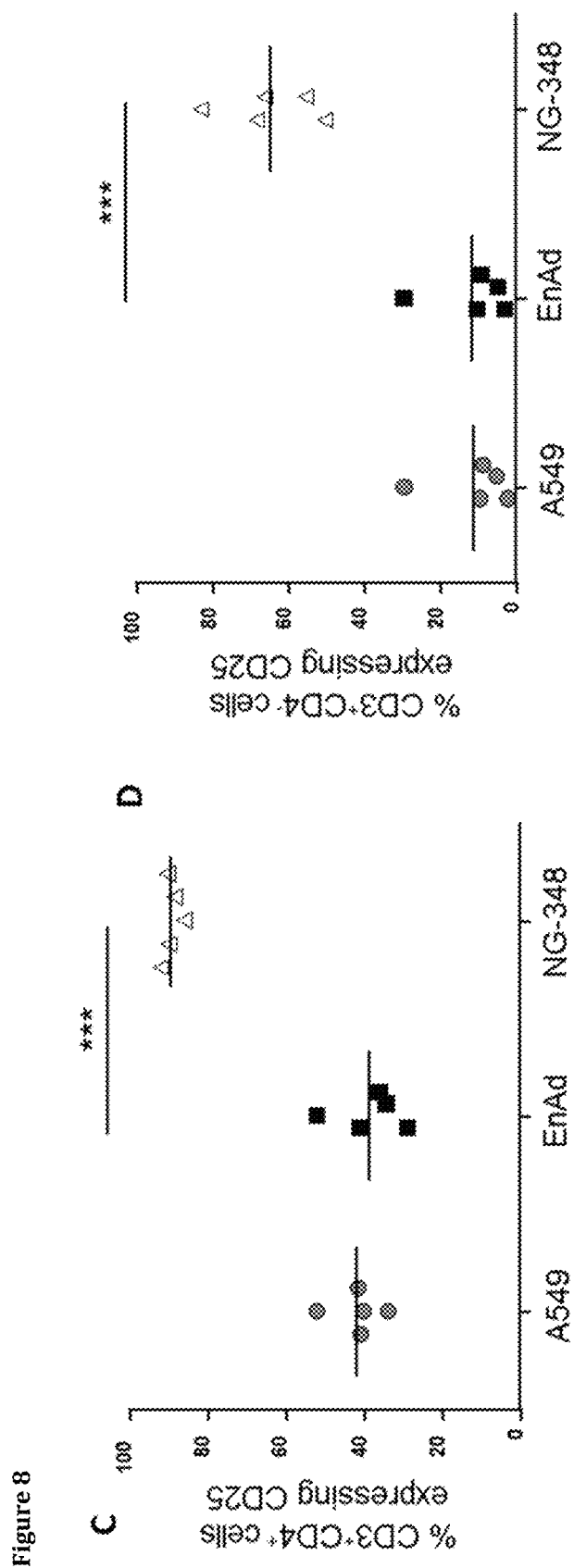

Flow cytometry analysis of T cell activation was assessed by expression of the T cell activation markers CD25 and HLA-DR on live, CD3$^+$, single cells. These data showed that both the number of T cells expressing CD25 (FIGS. 7A and 7B) and the average level of CD25 expression on the T cell surface (FIG. 7C) were significantly higher for T cells cultured with NG-348 infected A549 cells than EnAd or uninfected controls. Specifically, there was no difference in T cell activation status when comparing untreated controls to EnAd (26.9%±3.4% and 25.3±3.5% of T cells expressing CD25, respectively) whereas CD25 was upregulated on the majority of cells co-cultured with NG-348 (83.2±1.5%). CD25 expression was also analysed on CD4 and CD8 T cell subsets by gating the CD3$^+$ T cells based on their expression of CD4. These analyses showed that CD25 expression is significantly upregulated on both CD4$^+$ and CD4− T cell subsets in NG-348 treated co-cultures compared to EnAd and uninfected controls (FIG. 8).

Figure 9:
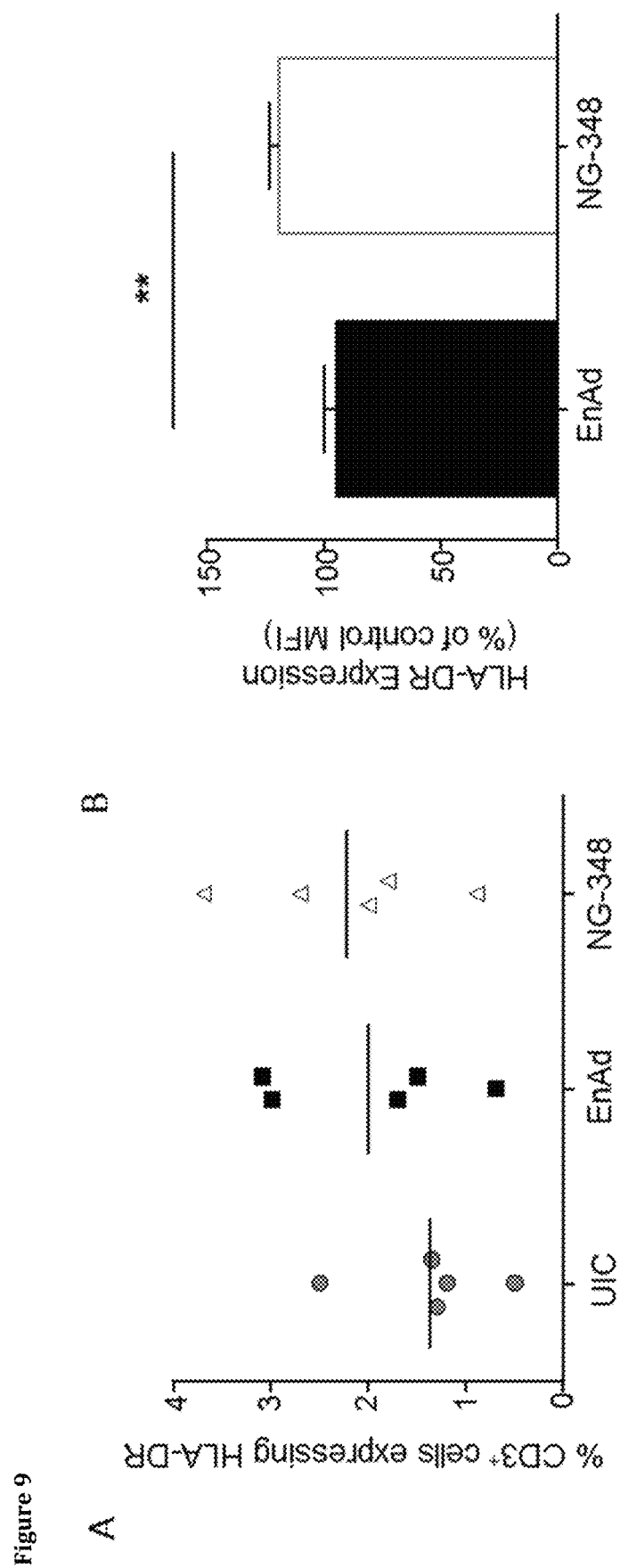
FIG. 9 shows low level of HLA-DR expression on human CD3$^+$ T cells following co-culture with NG-348 or EnAd infected A549 cells

In contrast to CD25 the number of cells expressing HLA-DR was low, <5%, for all conditions tested (FIG. 9A). This is likely due to the early time point after co-culture at which flow cytometry analysis was carried out. However, there was a slight but significant increase in the mean fluorescence intensity of HLA-DR staining CD3$^+$HLA-DR$^+$ cells from NG-348 treated co-cultures compared to controls (FIG. 9B).

Stimulation of T Cell Degranulation

Figure 10:
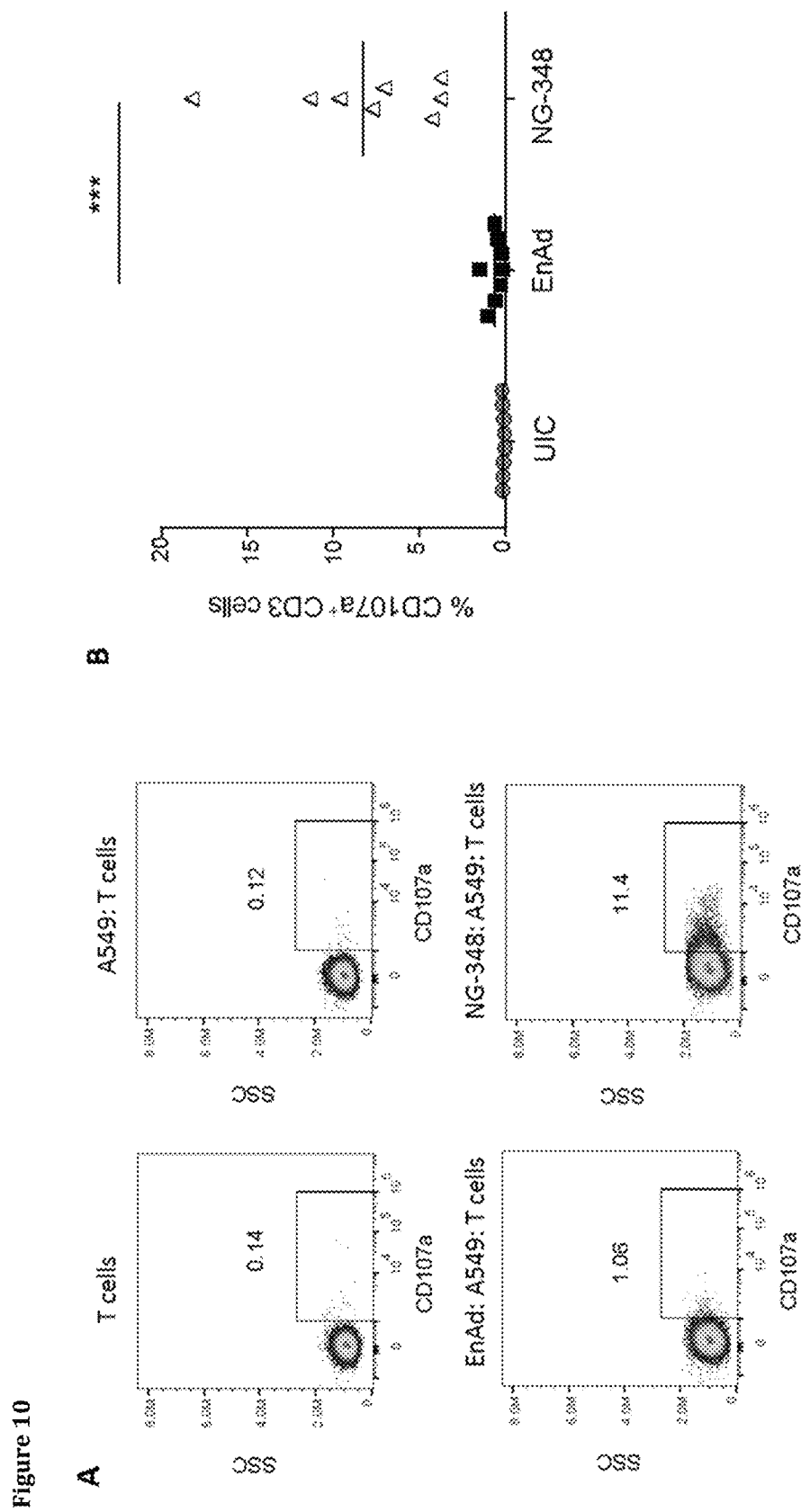
FIG. 10 shows induction of CD107a expression on the surface of live, CD3$^+$ T cells following co-culture with NG-348 infected A549 cells, but not when infection was with EnAd.
Figure 11:
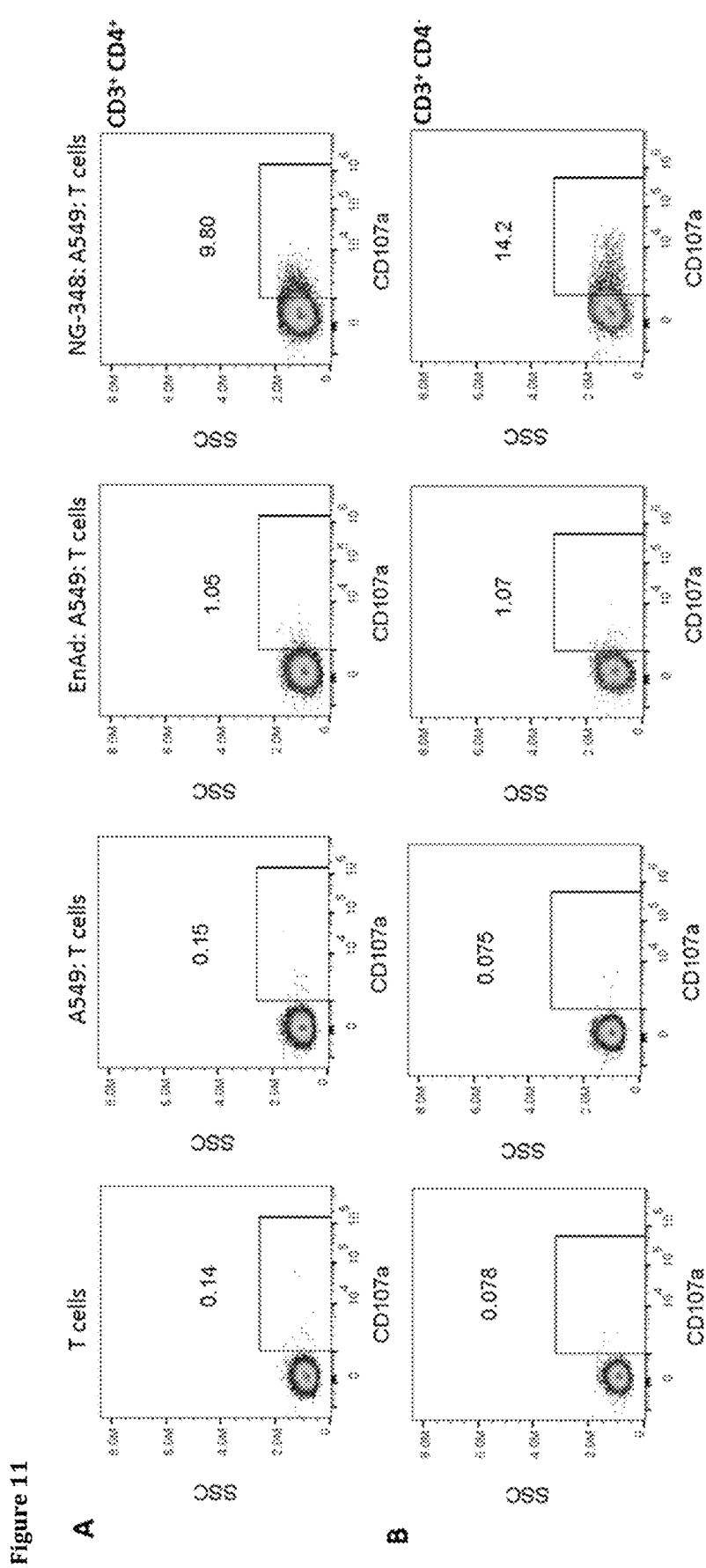
FIG. 11 shows induction of CD107a expression on the surface of both CD4$^+$ and CD4$^-$ CD3$^+$ T cell subsets following co-culture with NG-348 infected A549 cells, but not when infection was with EnAd.
Figure 11:
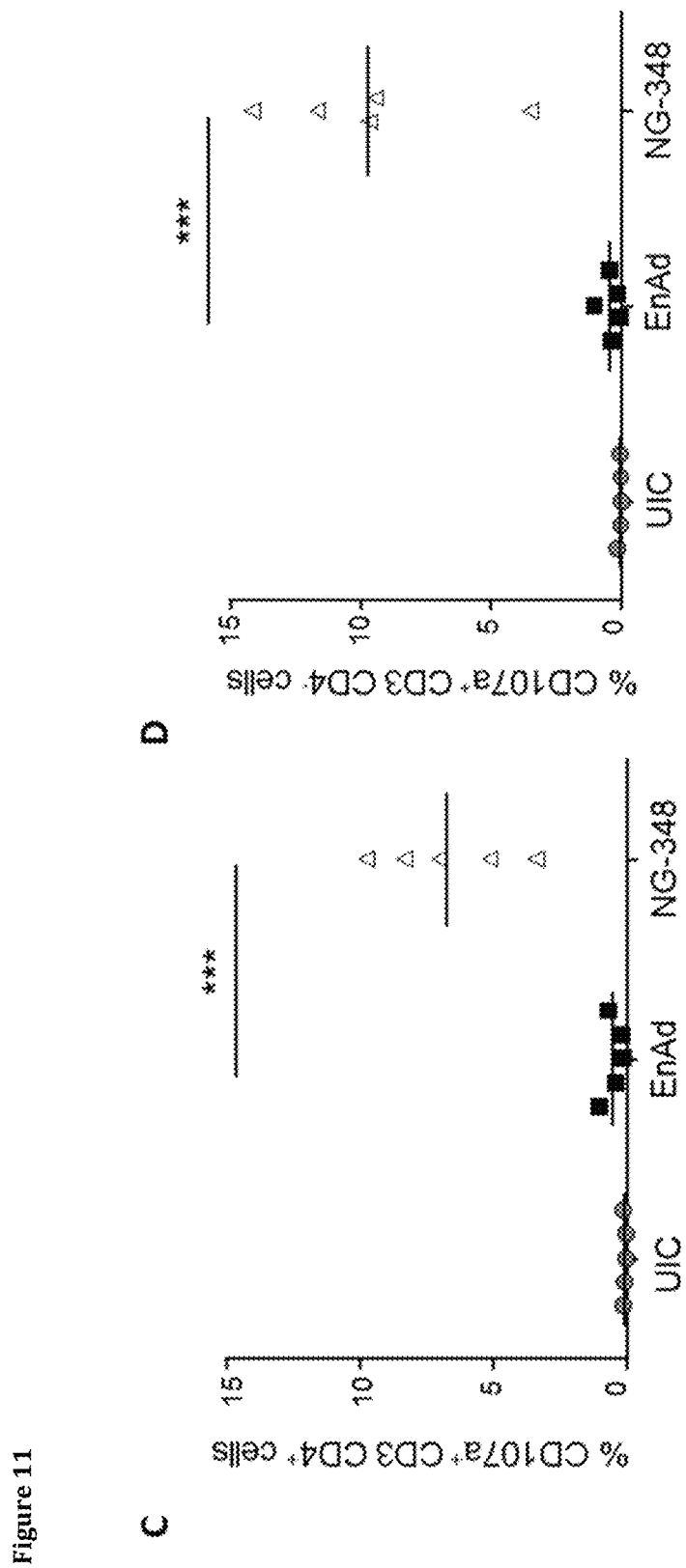

Analysis of CD107a expression on the surface of live, CD3$^+$ T cells showed a significant increase in the number of T cells which had degranulated and were therefore stained with CD107a, when A549 cells were infected with NG-348 (8.3%±1.7% of cells) compared to either EnAd (0.6%±0.2% of cells) or untreated controls (0.1%±0.02% of cells) (FIG. 10). Similar to CD25 upregulation, both CD4$^+$ and CD4− T cell subsets showed significantly increased CD107a expression compared to EnAd or A549 controls (FIG. 11).

Secretion of the Stimulatory Cytokines IL-2 and IFNγ

For detection of IL-2 or IFNγ expression, co-culture supernatants were diluted into 5% BSA/PBS assay buffer (in a range of 1:100 to 1:1000) and ELISA was carried out using the Human IL-2 Ready Set go Kit (Affymetrix) or Human IFN gamma Ready set go kit (Affymetrix) according to the manufacturer's protocol.

The concentrations of secreted IL-2 or IFNγ were determined by interpolating from the standard curves. Expression of IL-2 could only be detected in the supernatants of co-cultures using NG-348 infected A549 cells and was not detectable in either the EnAd, or untreated controls (FIG. 12A). Expression of IFNγ could also be detected, at very high levels (>300 ng/mL) in supernatants of co-cultures from NG-348 infected A549 cells, which was significantly higher that either EnAd or untreated controls (FIG. 12B).

Example 7: T Cell Activation of CD4 and CD8 T Cells Can Be Independently Mediated By NG-348 Infected Carcinoma Cell Lines A549 lung carcinoma cells infected with NG-348 or EnAd virus particles or left uninfected, were co-cultured with either CD4$^+$ T cells or CD8$^+$ T cells isolated from human PBMC donors. T cell activation was assessed by the secretion of the stimulatory cytokine IFNγ into culture supernatants.

A549 cells were seeded and infected with NG-348 or EnAd virus particles or left uninfected according to the methods detailed in Example 14. 48 hrs post infection CD4$^+$ T cells or CD8$^+$ T cells isolated by negative selection from a PBMC donor were added to the A549 cell monolayer at a ratio of 8 T cells to 1 tumour cells. After 16 hrs of co-culture supernatants were harvested and assessed for IFNγ according to the methods detailed.

Analysis of IFNα Expression By ELISA

Supernatants of HT-29 or A549 cell lines infected for 24, 48 or 72 hrs with 10 ppc of EnAd or NG-343 or left uninfected were analysed for expression of secreted IFNα by ELISA.

Culture supernatants were removed from each well and centrifuged for 5 mins, 1200 rpm to remove cell debris. Supernatants were diluted into 5% BSA/PBS assay buffer (1:2 or 1:50 or 1:100) and ELISA was carried out using the Verikine Human IFN alpha Kit (Pbl assay science) according to the manufacturer's protocol.

The concentrations of secreted IFNα were determined by interpolating from the standard curves. IFNα expression which increased in the cellular supernatants over the course of infection was detected in both HT-29 and A549 cells lines For CD4$^+$ T cells Expression of IFNγ was only detected in supernatants of co-cultures from NG-348 infected A549 cells and was not detectable in either the EnAd or untreated controls (FIG. 13A). For CD8$^+$ T cells expression of IFNγ was detected at significantly higher levels for NG-348 infected A549 cells than for EnAd or untreated controls (FIG. 13B), demonstrating that both CD8 and CD4 cells can be activated to secret IFNγ by NG-348 virus activity in tumour cell lines.

Example 8

A549 human lung carcinoma cells and MRC5 human fibroblast cells were cultured with EnAd, NG-347 or NG-348 viruses (at 10 ppc) to compare virus genome replication, virus hexon and transgene expression by these cell types. After 72 hours culture, cells were either stained for FACS analyses of surface markers or supernatants and cell lysates prepared for virus genome replication (qPCR) or mRNA (RT-qPCR) analyses of hexon or transgene expression.

Figure 14:
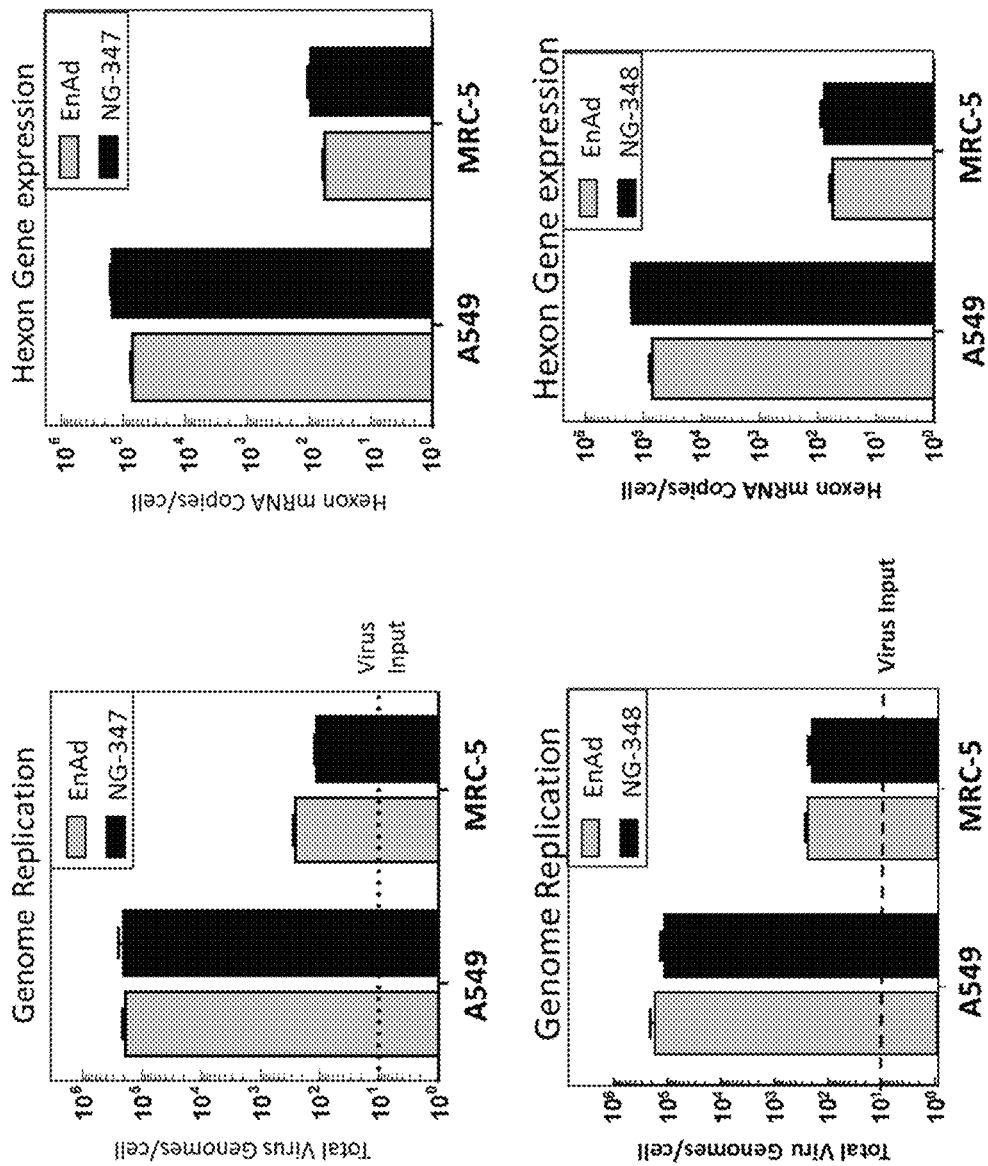
FIG. 14 shows genome replication and hexon gene expression (mRNA levels) for EnAd, NG-347, and NG-348 in MRC-5 fibroblast cells compared to A549 tumour cells

Virus genome replication and hexon mRNA expression for the two transgene bearing viruses, NG-347 and NG-348 were equivalent to those for the parental virus, EnAd (FIG. 14). For NG-348 (FIG. 15), CD80 and anti-human CD3-ScFv transgene mRNA expression levels were high with A549 tumour cells, with only a low level signal for the non-tumour MRC5 cells. CD80 protein expression on the surface of cells assessed by FACS was detected on the majority of NG-348 treated A549 cells but was not detectable on MRC5 cells, with no CD80 detected on either cell type left untreated or treated with EnAd. Similarly, CD80 transgene mRNA and protein expression following NG-347 treatment was selectively detected in A549 tumour cells not MRC5 cells (FIG. 16). For EnAd and NG-347 treated cell cultures, levels of MIP1α and IFNα mRNA in cell lysates and secreted proteins in supernatants were measured by RT-qPCR and specific ELISAs, respectively. Data (FIG. 17) show selective expression of both transgenes by A549 tumour cells, with no detectable MIP1α chemokine or IFNα cytokine in MRC5 supernatants.

Example 9

Figure 18:
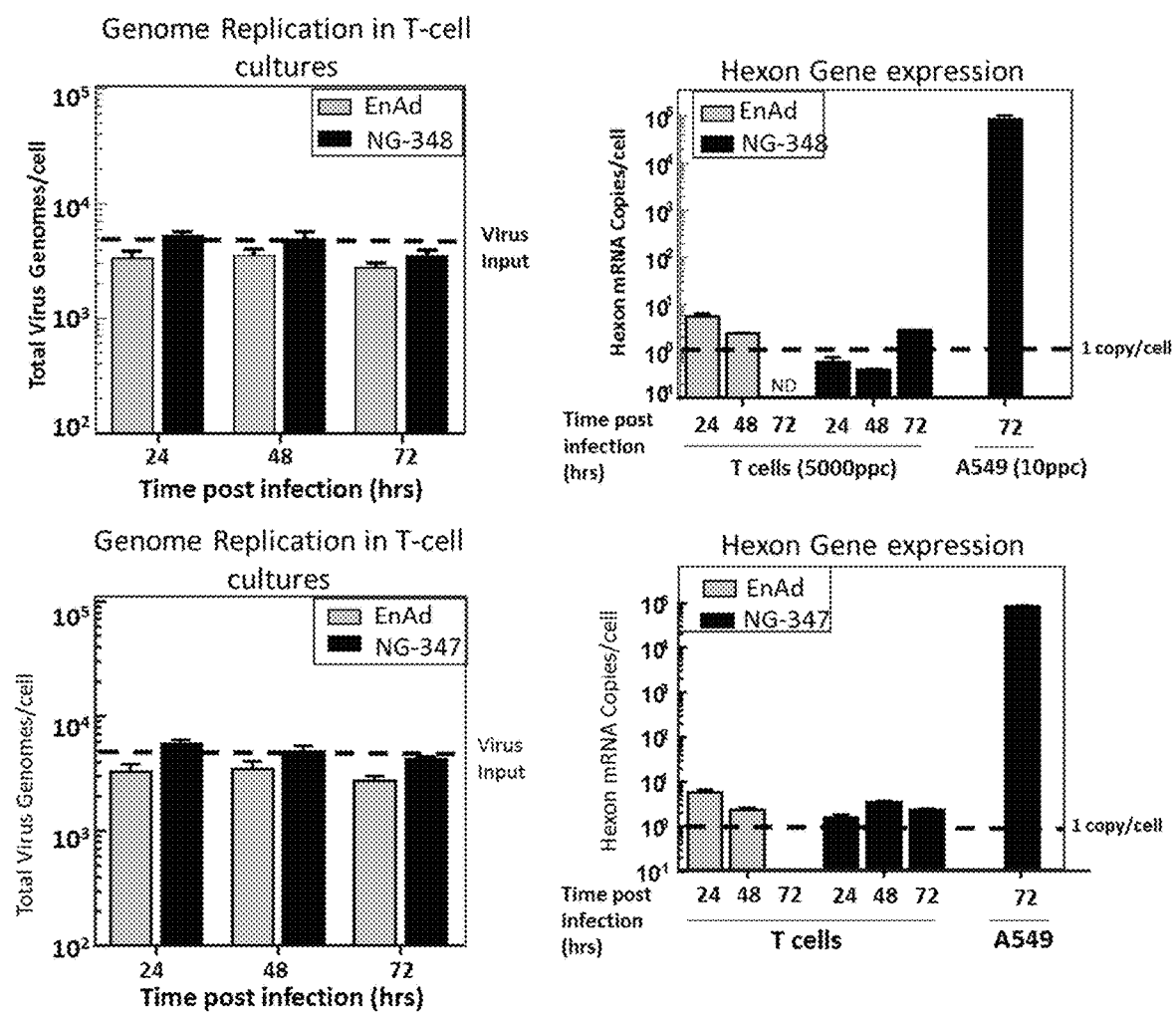
FIG. 18 shows genome replication and hexon gene expression (mRNA levels) for EnAd, NG-347, and NG-348 in purified human T-cell cultures.
Figure 19:
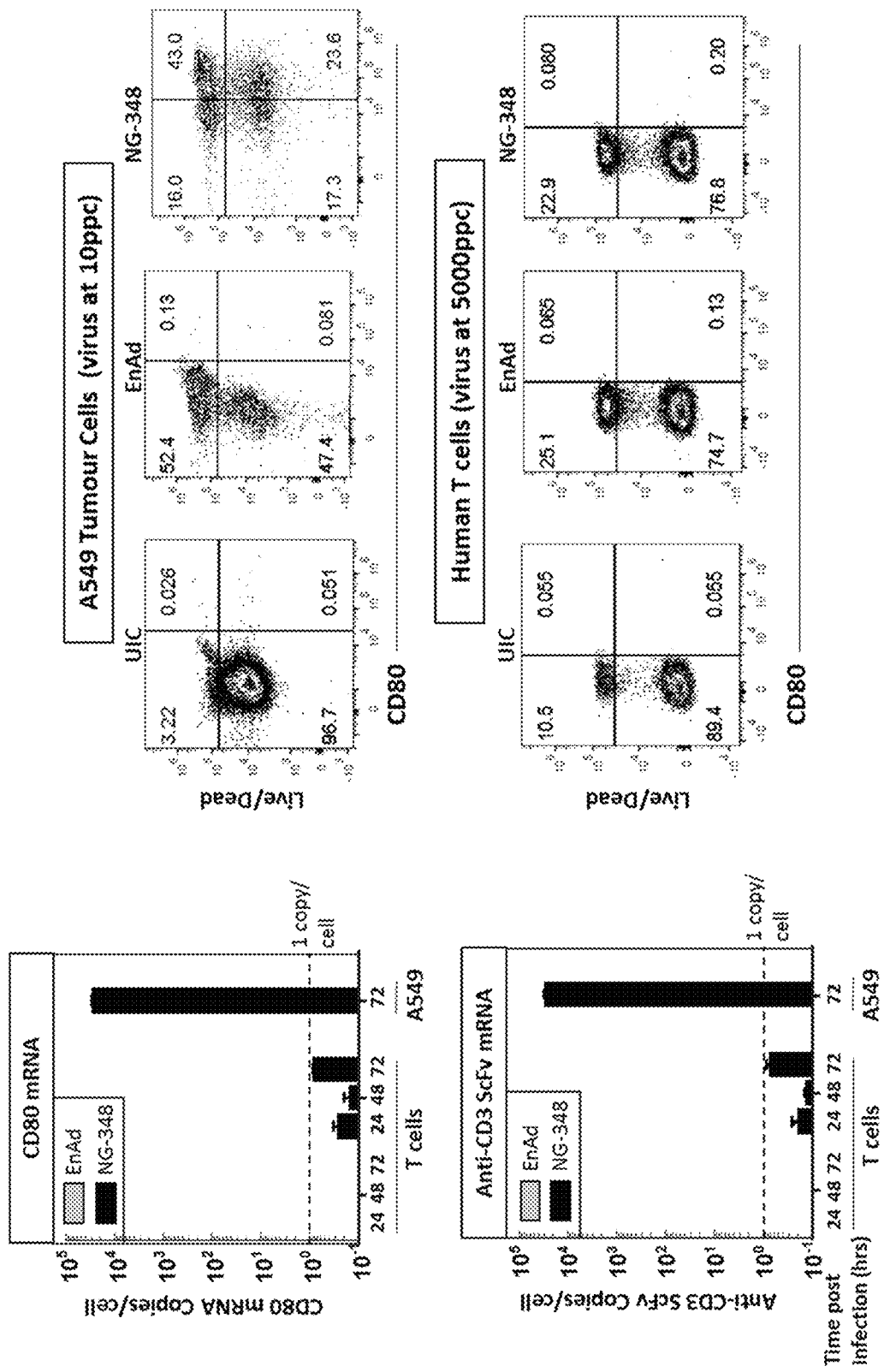
FIG. 19 shows CD80 and anti-CD3 scFv transgene mRNA and protein expression (flow cytometry) for virus NG-348 in human T-cells compared to A549 tumour cells
Figure 20:
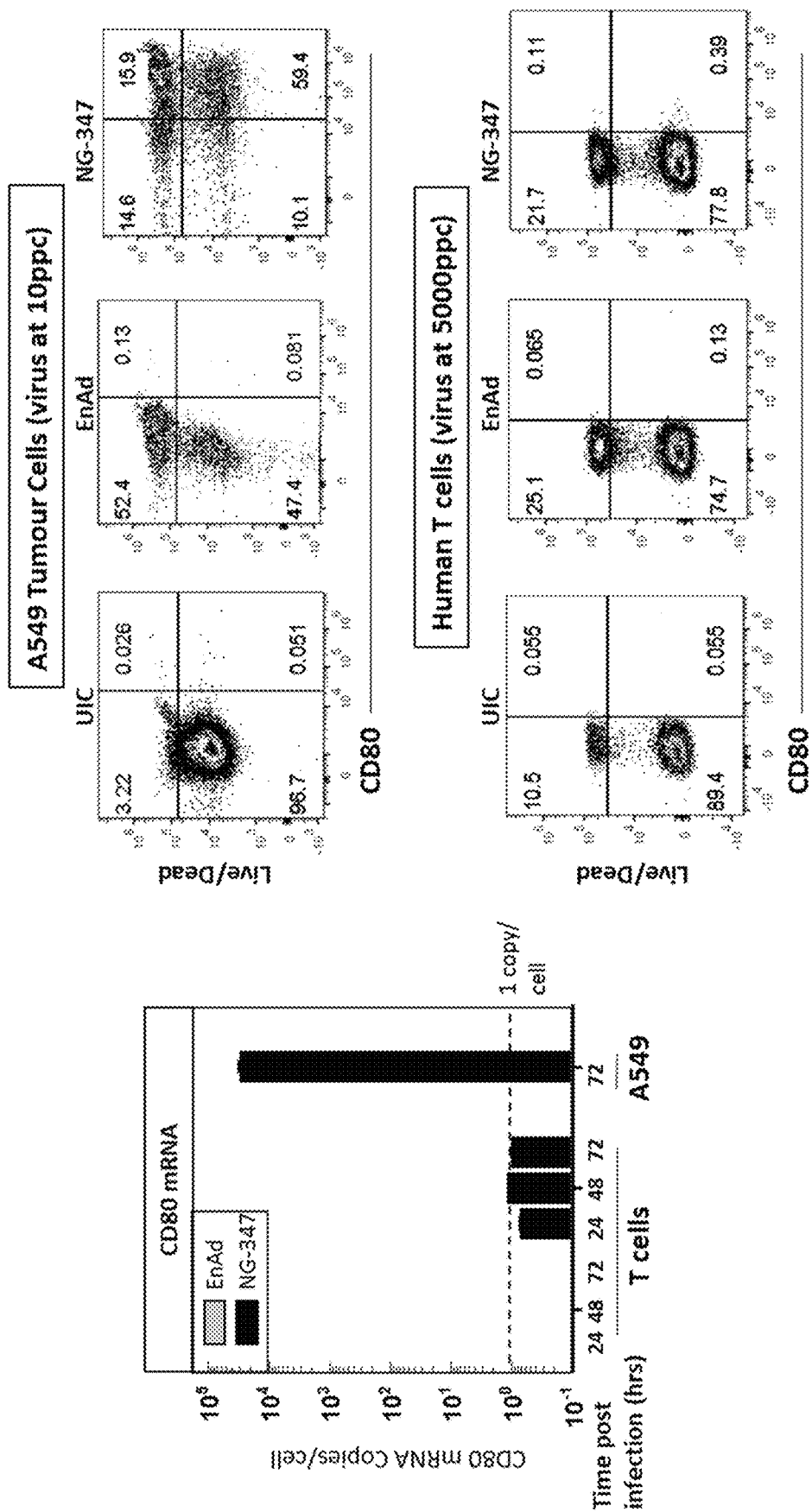
FIG. 20 shows CD80 transgene mRNA and CD80 transgene protein for virus NG-347 in purified human T-cells compared to A549 tumour cells
Figure 22:
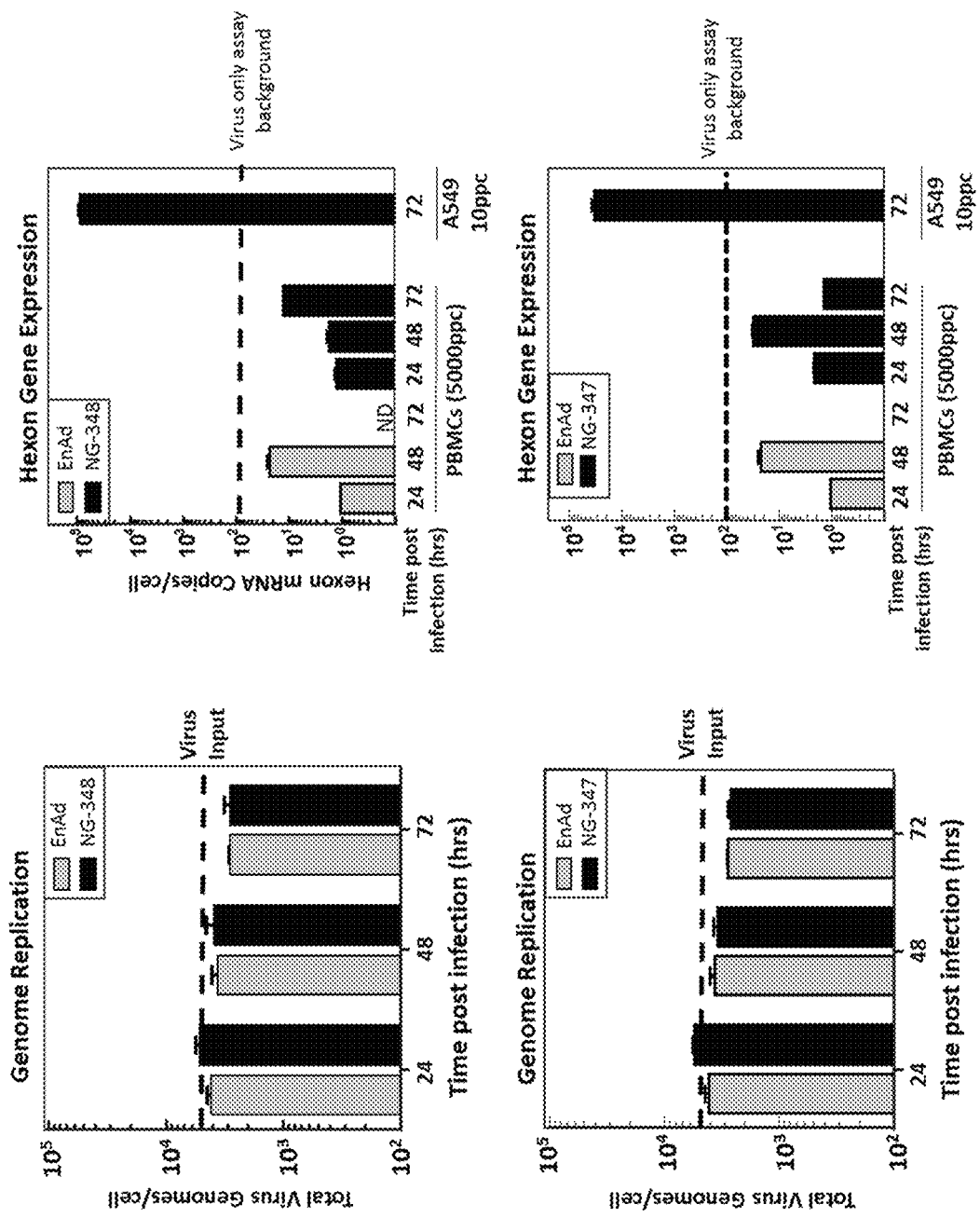
FIG. 22 shows NG-347 and NG-348 genome replication and hexon gene expression by human PBMCs compared to A549 tumour cells
Figure 23:
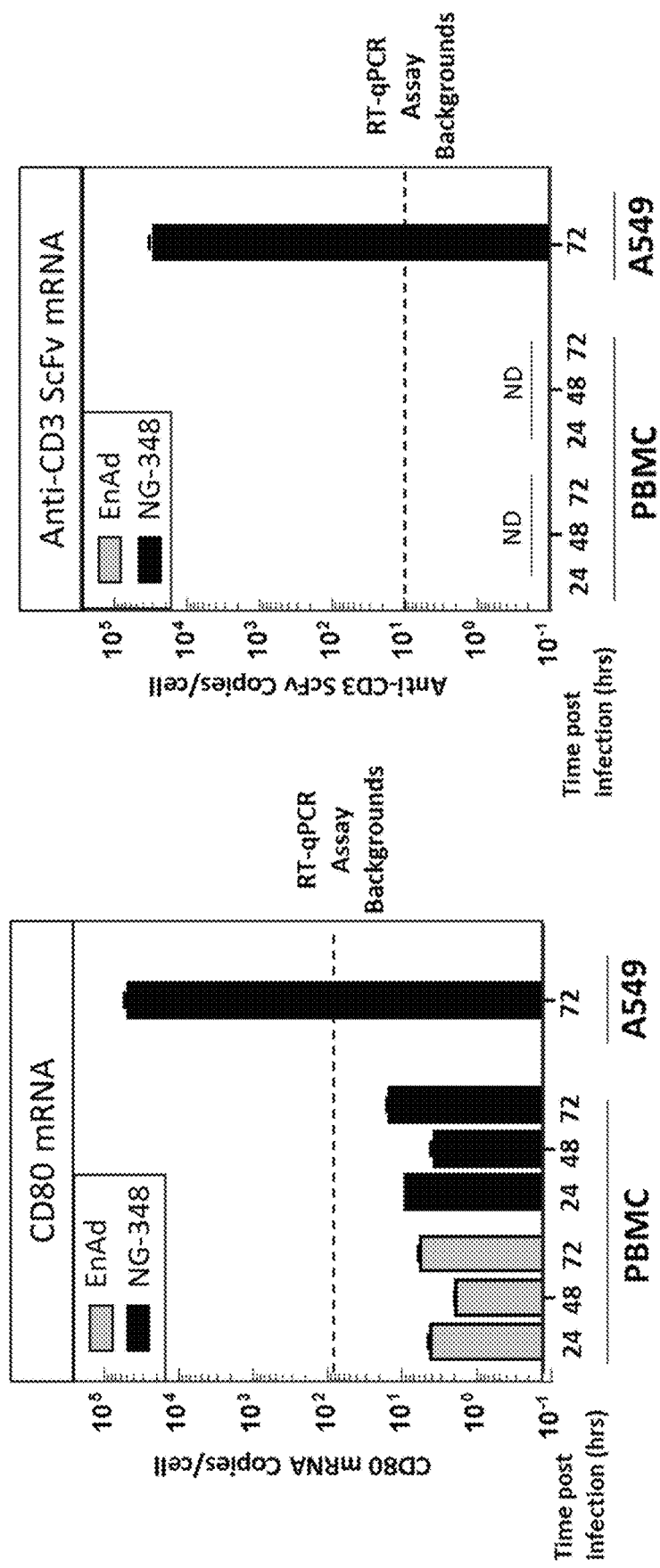
FIG. 23 shows CD80 and anti-CD3 scFv mRNA generated by virus NG-348 by PBMCs compared to A549 tumour cells
Figure 24:
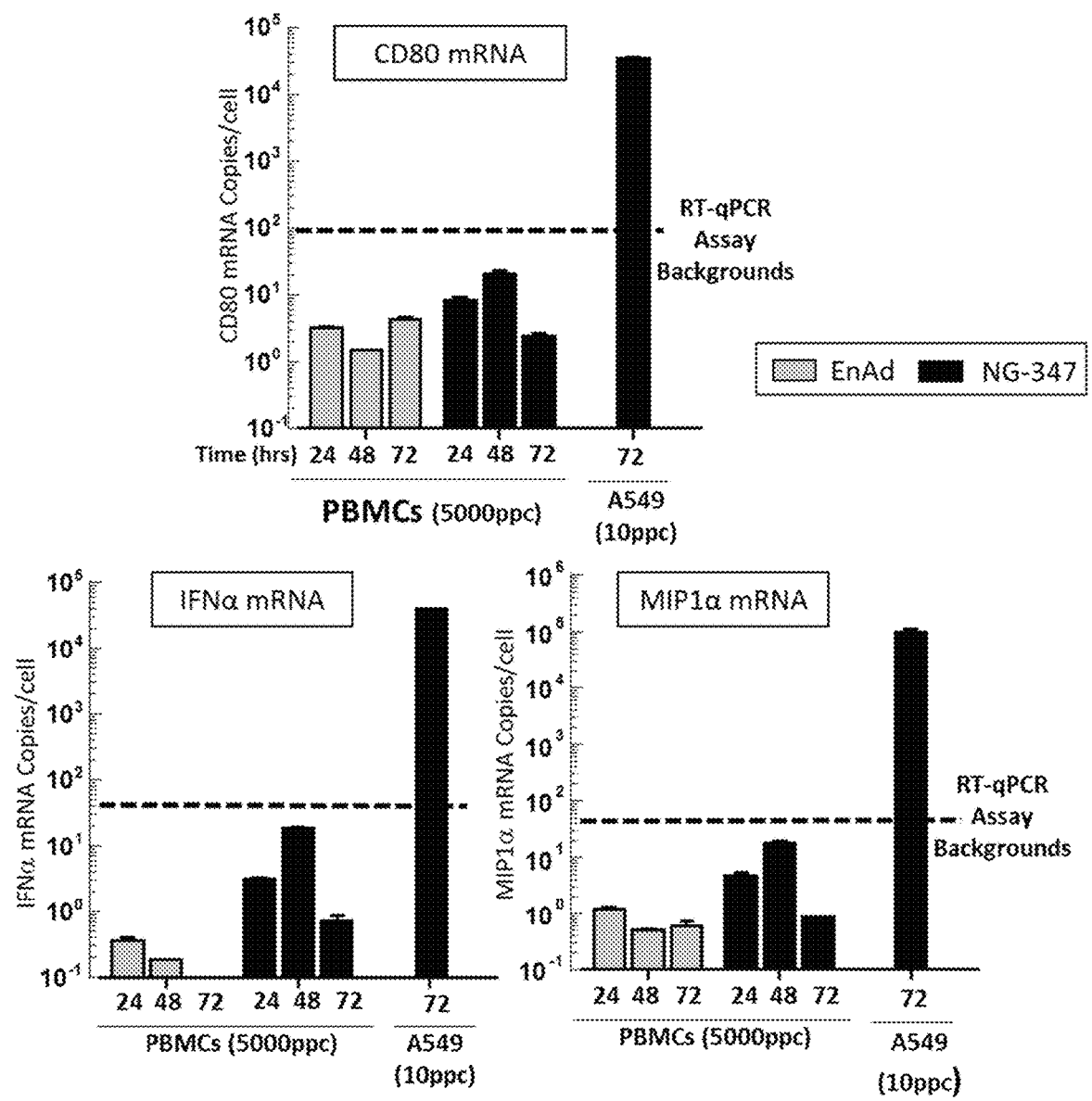
FIG. 24 shows CD80, IFNα and MIP1α mRNA generated by virus NG-347 by PBMCs compared to A549 tumour cells
Figure 25:
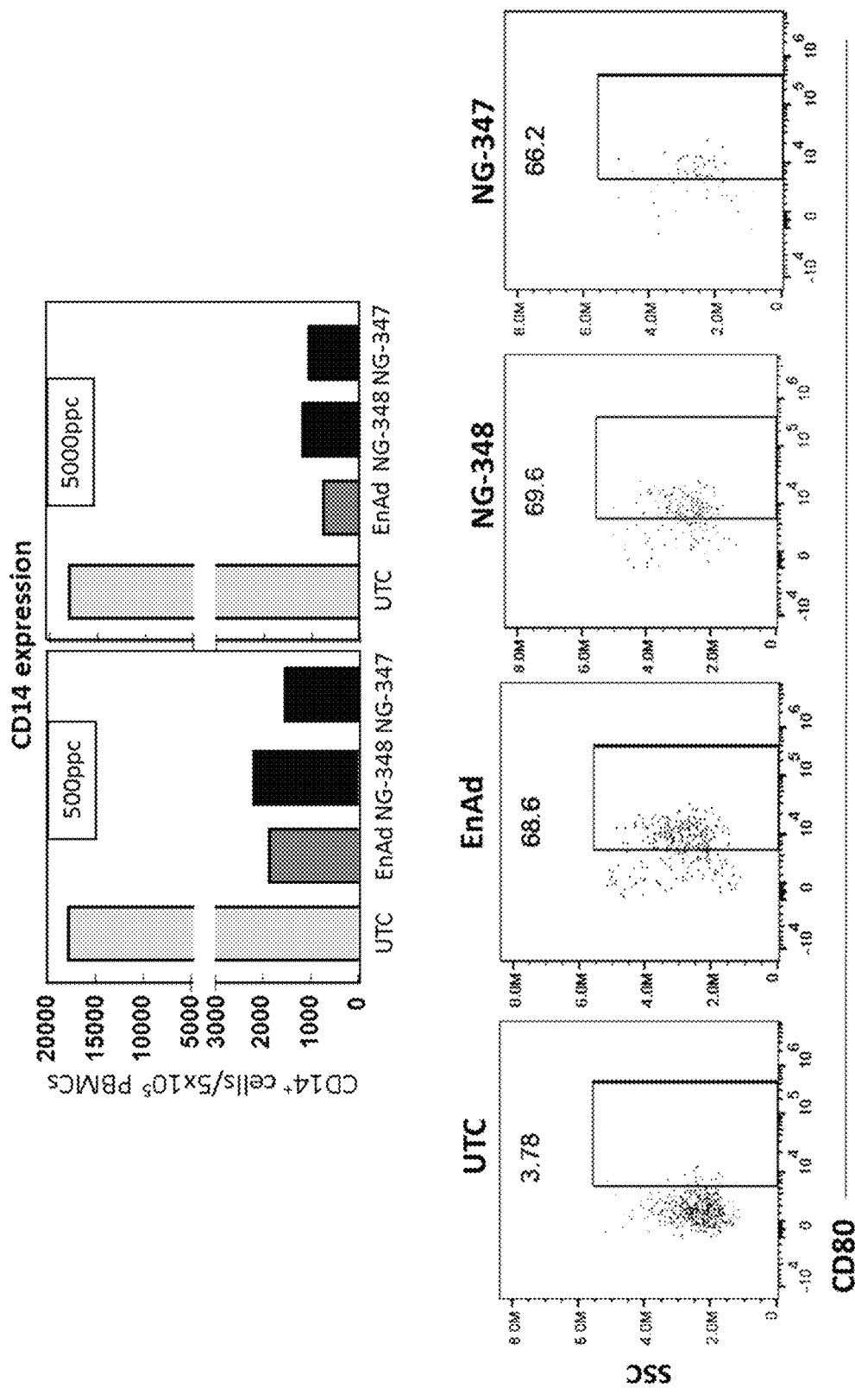
FIG. 25 shows the similar activation of human dendritic cells by EnAd, NG-347 and NG-348 virus particles, as measured by down-regulation of CD14 expression and upregulation of CD80 on the cell surface

The selectivity/activity of EnAd, NG-347 and NG-348 viruses with human T-cells was evaluated by culturing isolated CD3+ T cells for 3 days with either 500 ppc or 5000 ppc of each virus. Selectivity/activity was assessed by a) flow cytometry analysis of T cells stained with antibodies targeting CD69, CD4, CD80, CD25 and CD3, b) ELISA analysis of human MIP1α, IFNα and IFNγ protein secretion, c) qPCR analysis of virus replication and d) RT-qPCR analysis of gene expression As shown in FIG. 18, T-cells were not supportive of virus genome replication for any of the viruses tested with only background signals in the virus hexon RT-qPCR assay. A549 tumour cells supported high levels of hexon mRNA expression. RT-qPCR analyses for transgene mRNA expression by T-cells showed only background signals (<1 copy/cell) for CD80 by both NG-347 and NG-348, and a similar lack of significant expression of anti-CD3-ScFv mRNA by NG-348, despite the high virus exposure (5000 ppc). High levels of expression of both transgenes were detected with treated (10 ppc) A549 tumour cells (FIGS. 19 & 20). Expression of IFNα and MIP1α transgene mRNA was also selectively detected by NG-347 (not EnAd) treated A549 tumour cells (at 10 ppc) and not by T-cells treated with 5000 ppc (FIG. 21). In addition, CD80 cell surface protein expression was only detectable with A549 cells not T-cells for both NG-347 and NG-348 (FIGS. 19 & 20). EnAd treatment did not lead to CD80 expression by either cell type, and A549 cell death (as assessed by dye uptake) was similarly high for all three viruses; a low level of non-specific T-cell death was induced by all viruses due to the very high levels of virus particles used in the experiment (FIGS. 19 & 20). Similar transgene mRNA and protein expression data were obtained when viruses were used at 500 ppc (data not shown).

In the absence of tumour cells, purified human T-cells were not activated to upregulate activation markers CD25 or CD69 when cultured with any of the viruses (Table 6).

TABLE 6

Lack of expression of activation markers CD25 and CD69 by purified human CD3+ T-cells treated with 5000 ppc of different viruses

|  | Untreated | EnAd | NG-347 | NG-348 |
|---|---|---|---|---|
| CD25+ CD4 T-cells | 30.7 | 24.6 | 23.4 | 23.3 |
| CD69+ CD4 T-cells | 0.1 | 0.4 | 0.3 | 0.7 |
| CD25+ CD8 T-cells | 5.9 | 4.7 | 4.1 | 4.1 |
| CD69+ CD8 T-cells | 0.5 | 1.0 | 0.9 | 1.3 |

Example 10

A similar virus selectivity experiment to that described in Example 9 was carried out using unseparated human PBMCs rather than purified T-cells, including making the same activity assessments. As with human T-cells in example 9, the data from this study collectively demonstrate lack of virus replication and transgene expression by human PBMCs. FIGS. 12-14 show data using 5000 ppc of EnAd, NG-347 or NG-348, but similar data was generated using 500 ppc (not shown). FIG. 12 shows virus genome replication and hexon mRNA expression and FIGS. 13 & 14 show transgene mRNA expression. Assay backgrounds were set according to signals generated in the assay with the respective virus spiked into culture media and then processed in the same way as for the cell lysate samples. There was no detectable expression of CD80 transgene on CD3+ T-cells or CD40+ cells (primarily B-cells) in these PBMC cultures with any of the viruses (not shown).

Figure 15:
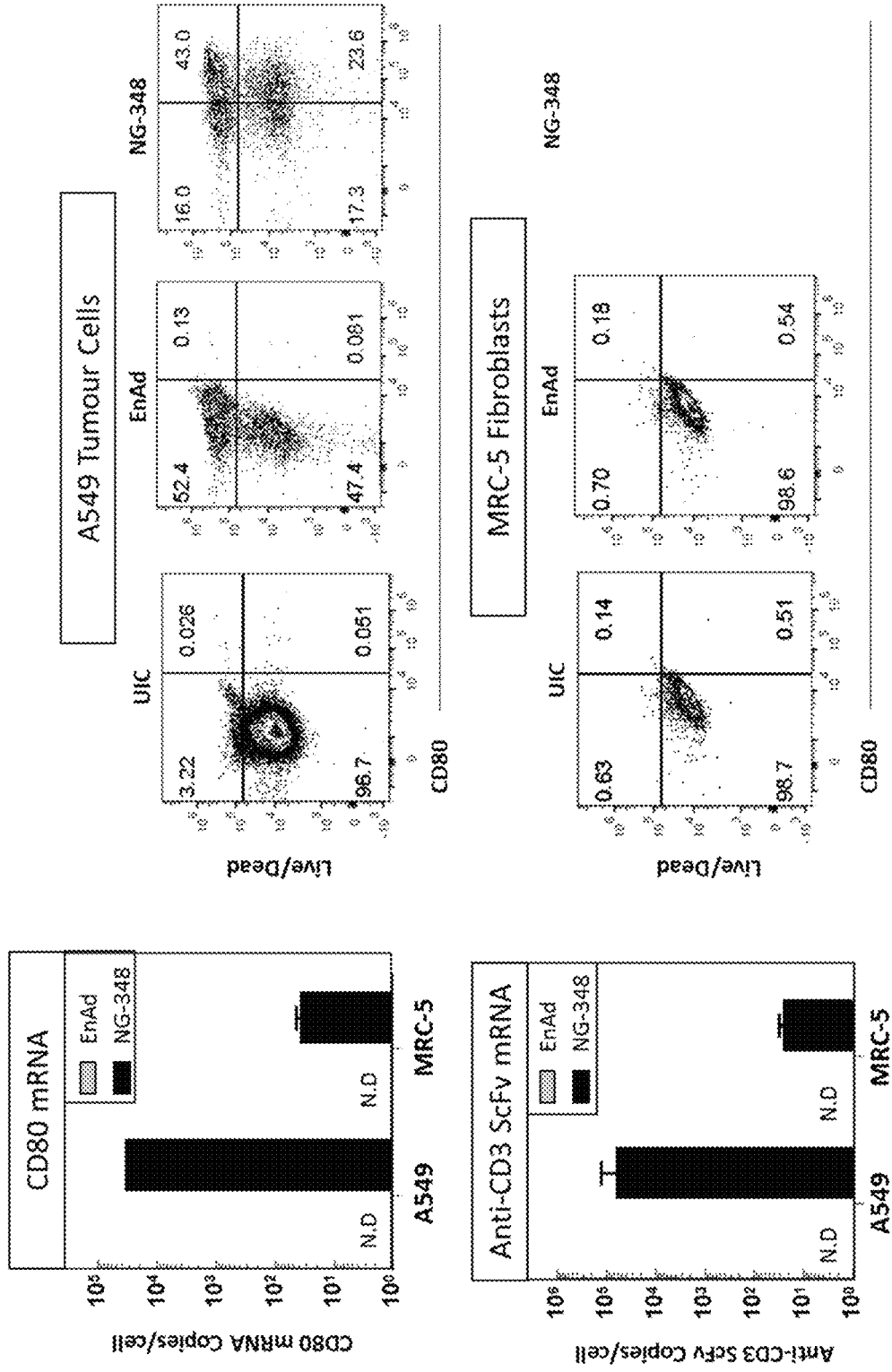
FIG. 15 shows CD80 and anti-CD3-scFv transgene mRNA and CD80 trasngene protein (flow cytometry) expression for virus NG-348 in MRC-5 fibroblast cells compared to A549 tumour cells
Figure 16:
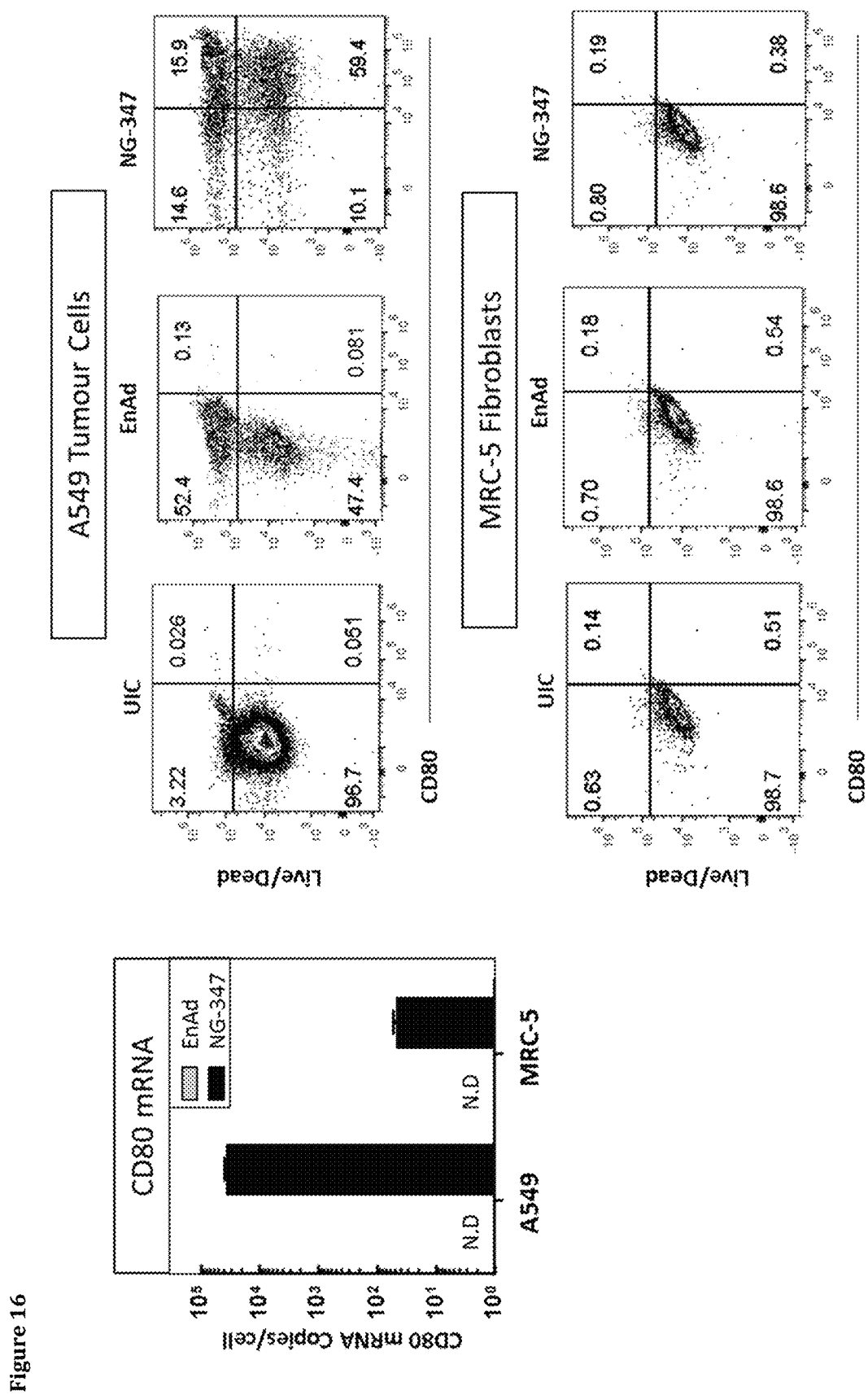
FIG. 16 shows CD80 transgene mRNA and CD80 transgene protein for virus NG-347 in MRC-5 fibroblast cells compared to A549 tumour cells.

NG-347 and NG-348 virus particle-mediated activation of innate immune cells (monocytes, DCs) in the PBMC cultures were similar to those of EnAd, as shown in FIGS. 15 and 16 for downregulation of CD14 expression and upregulation of HLA-DR and endogenous cell surface CD80, as well as secretion of MIP1α and IFNα (note that despite NG-347 encoding both of these molecules in its genome there was no increase in production levels over those for EnAd and NG-348 which do not encode the transgenes).

Example 11

This example is similar in design to experiments in examples 9 and 22 10 in these studies, the human PBMCs or purified T-cells were co-cultured with virus pre-treated (48 hours) A549 tumour cells or MRC5 fibroblasts. A549 or MRC5 cells were treated with 10 ppc of EnAd, NG-347, NG-348 or left untreated (UTC) and cultured for 48 hours to allow sufficient time for virus replication and any transgene expression. PBMCs or T-cells were then added to the cultures and left for 24 or 48 hours to evaluate the ability of virus treated cells to activate T-cells.

Figure 17:
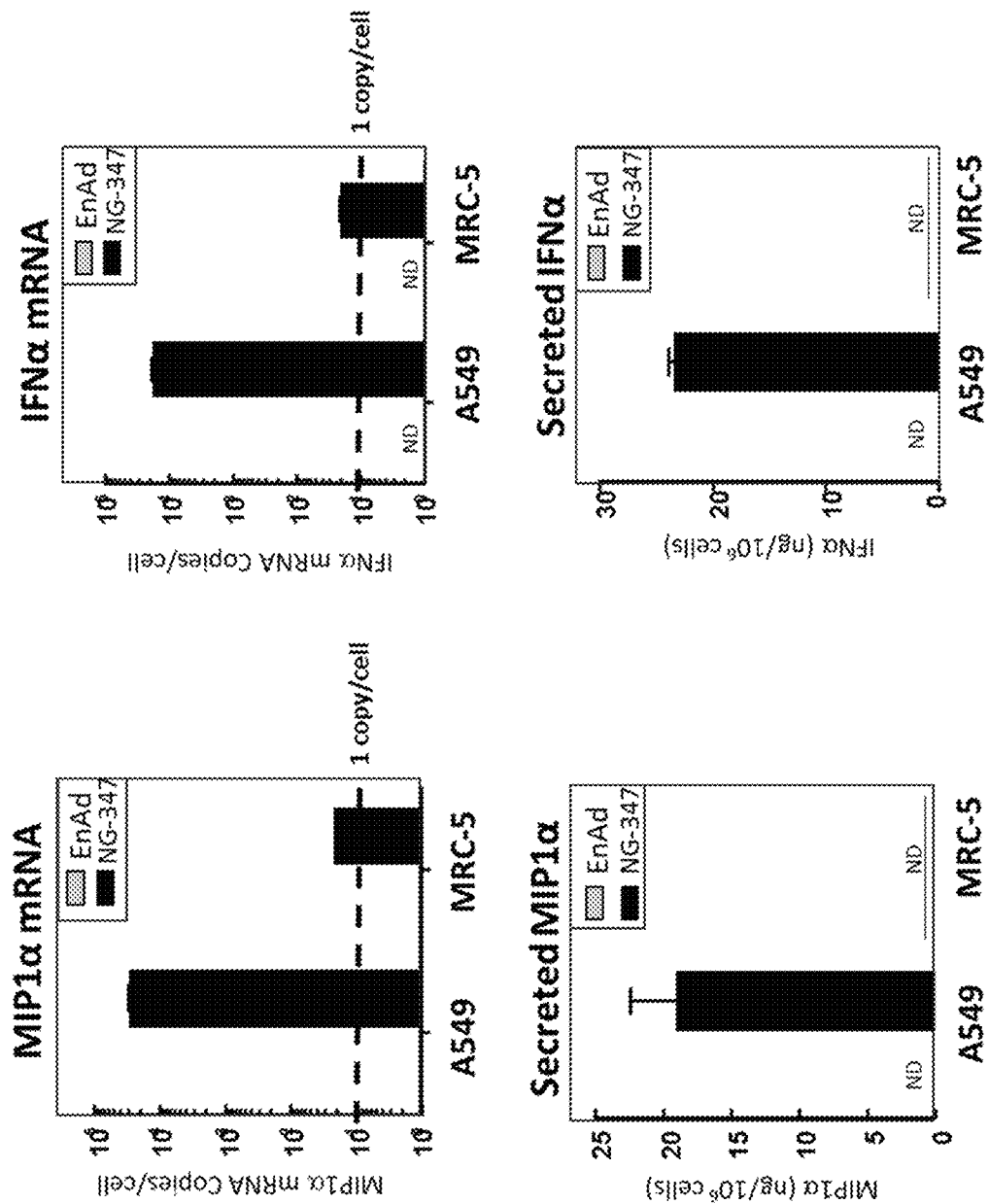
FIG. 17 shows mRNA and secreted protein levels of MIP1α and IFNα generated by virus NG-347 in MRC-5 fibroblast cells compared to A549 tumour cells.

FIG. 17 shows virus genome replication data showing comparable replication of the three viruses in PBMC or T-cell co-cultures with both cell types, replication levels being high with A549 tumour cells and low with MRC5 fibroblasts.

T-cell activation as measured by upregulation of CD25 surface expression and CD8 effector T-cell degranulation, as measured by upregulation of CD107a on the cell surface, and IFNγ production measured by intracellular cytokine staining were all selectively stimulated by NG-348 treated A549 cells compared to EnAd, with no stimulation mediated with MRC co-cultures (Table 7).

TABLE 7

Flow cytometry analyses of activation of human CD3+ T-cells in T-cell and PBMC co-cultures with viruses

| Cells | Treatment | % CD25+ | % CD8+CD107a+ | % IFNγ |
|---|---|---|---|---|
| A549 + T-cells | Untreated | 37.5 | 0.1 | 0.1 |
| A549 + T-cells | EnAd | 38.4 | 0.1 | 0.2 |
| A549 + T-cells | NG-348 | 88.2 | 17.9 | 12.0 |
| MRC5 + T-cells | Untreated | 38.8 | 0.3 | 0.4 |
| MRC5 + T-cells | EnAd | 38.9 | 0.2 | 0.4 |
| MRC5 + T-cells | NG-348 | 39.1 | 0.3 | 0.3 |
| A549 + PBMCs | Untreated | 28.3 | ND | ND |
| A549 + PBMCs | EnAd | 29.4 | ND | ND |
| A549 + PBMCs | NG-348 | 73.7 | ND | ND |
| MRC5 + PBMCs | Untreated | 23.0 | ND | ND |
| MRC5 + PBMCs | EnAd | 23.3 | ND | ND |
| MRC5 + PBMCs | NG-348 | 21.7 | ND | ND |

ND = Not determined

Figure 28:
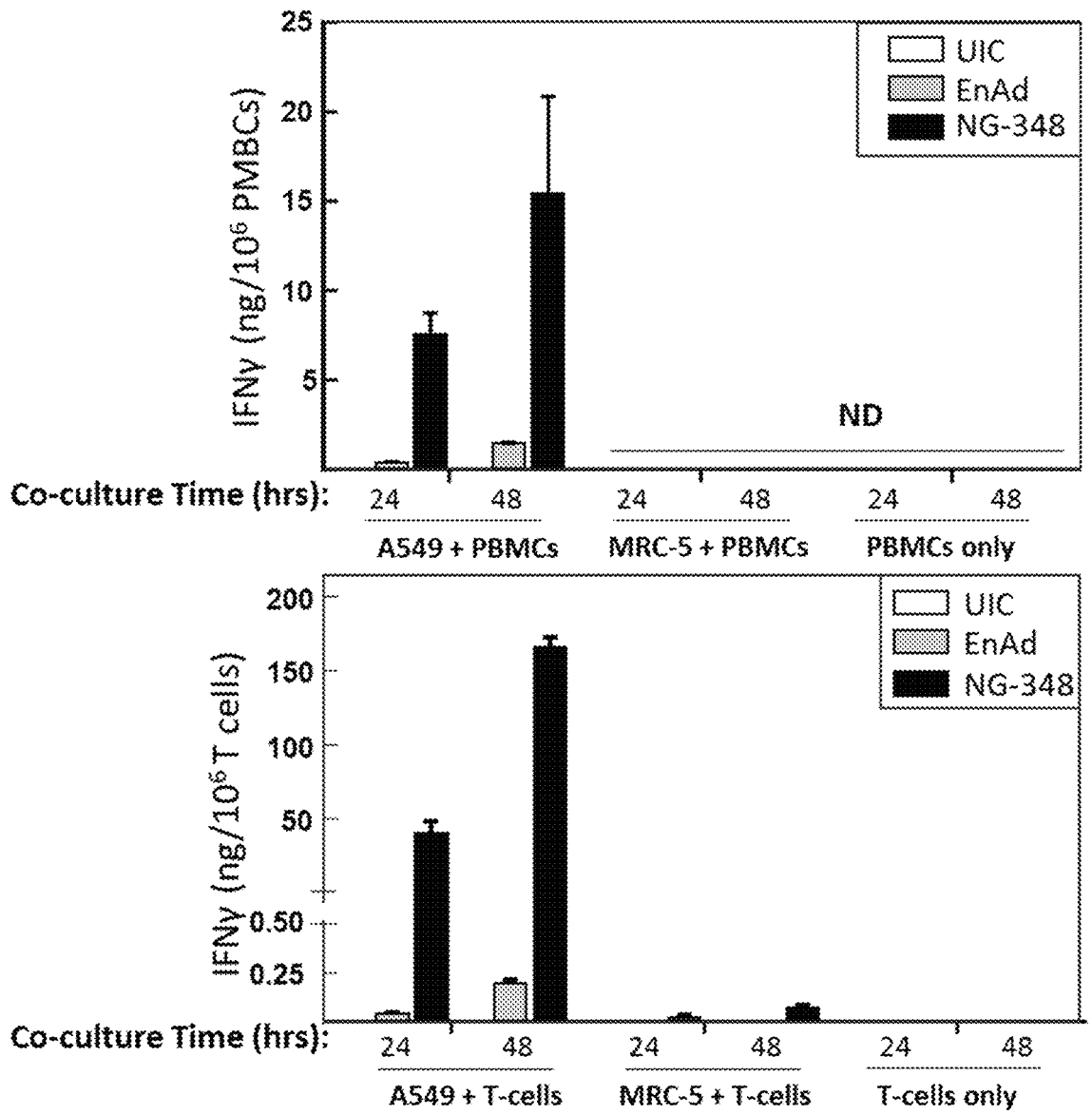
FIG. 28 shows INFγ secreted by PBMCs or T-cells co-cultured with MRC-5 fibroblast cells compared to A549 tumour cells, and treated with EnAd or virus NG-348.

IFNγ secretion into co-culture supernatants was also quantified by ELISA. The data (FIG. 28) similarly demonstrate selective activation of T-cells co-cultured with NG-348 treated A549 tumour cells not MRC5 fibroblasts, with either purified T-cells or PBMCs used in the assays.

Ability of NG-347 to activate T-cells was also assessed by measuring CD69 levels on T-cells from co-cultures of either purified T-cells or PBMCs with A549 tumour cells or MRC5 fibroblasts. As shown in Table 8, a small enhancement in CD69 positive T-cells was seen with NG-347 treatment of A549 tumour cells compared to EnAd, which itself leads to upregulation of this early activation marker. These effects were not seen in MRC5 co-cultures. No CD80 expression was detected on the T-cells (not shown).

TABLE 8

CD69 expression on T-cells from NG-347 or EnAd treated cocultures

| Cells | Treatment | % CD69+ |
| --- | --- | --- |
| A549 + T-cells | Untreated | 2.1 |
| A549 + T-cells | EnAd | 18.7 |
| A549 + T-cells | NG-348 | 35.0 |
| MRC5 + T-cells | Untreated | 3.8 |
| MRC5 + T-cells | EnAd | 3.6 |
| MRC5 + T-cells | NG-348 | 4.4 |
| A549 + PBMCs | Untreated | 1.2 |
| A549 + PBMCs | EnAd | 19.1 |
| A549 + PBMCs | NG-348 | 28.7 |
| MRC5 + PBMCs | Untreated | 2.6 |
| MRC5 + PBMCs | EnAd | 2.7 |
| MRC5 + PBMCs | NG-348 | 3.9 |

Figure 41:
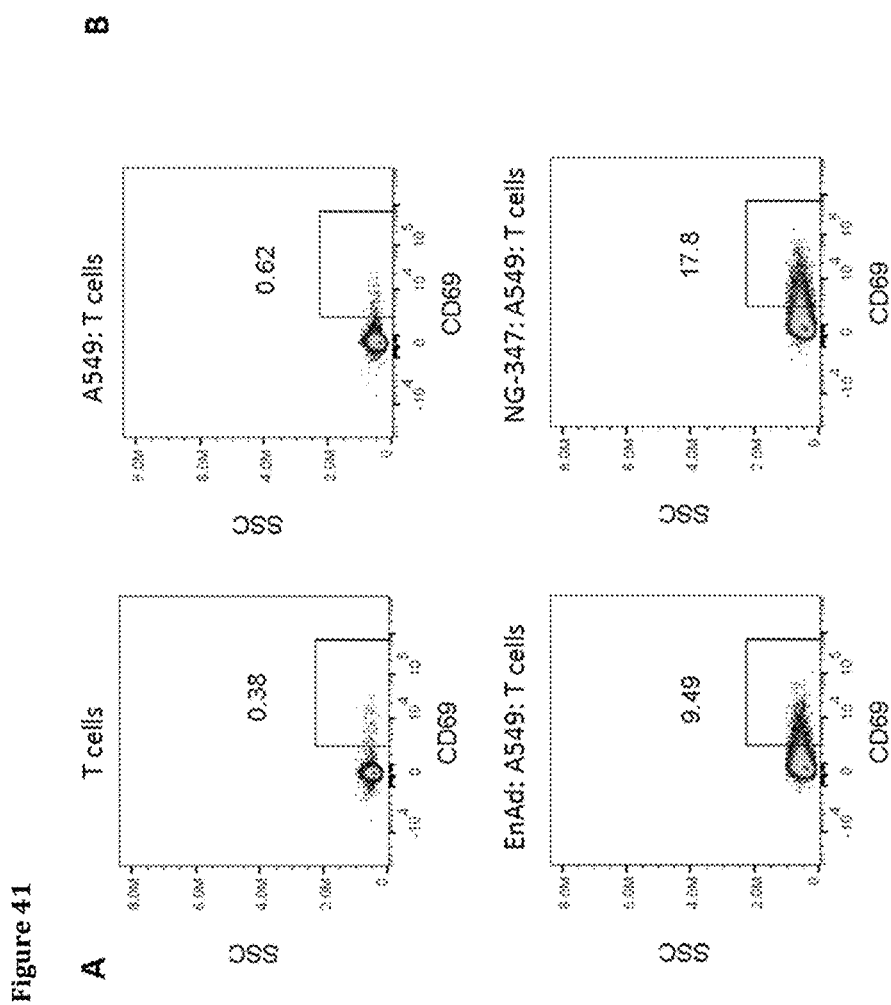
FIG. 41 shows CD69 is upregulated on more human CD3+ T-cells following co-culture with NG-347 infected A549 cells than when infection was with EnAd
Figure 42:
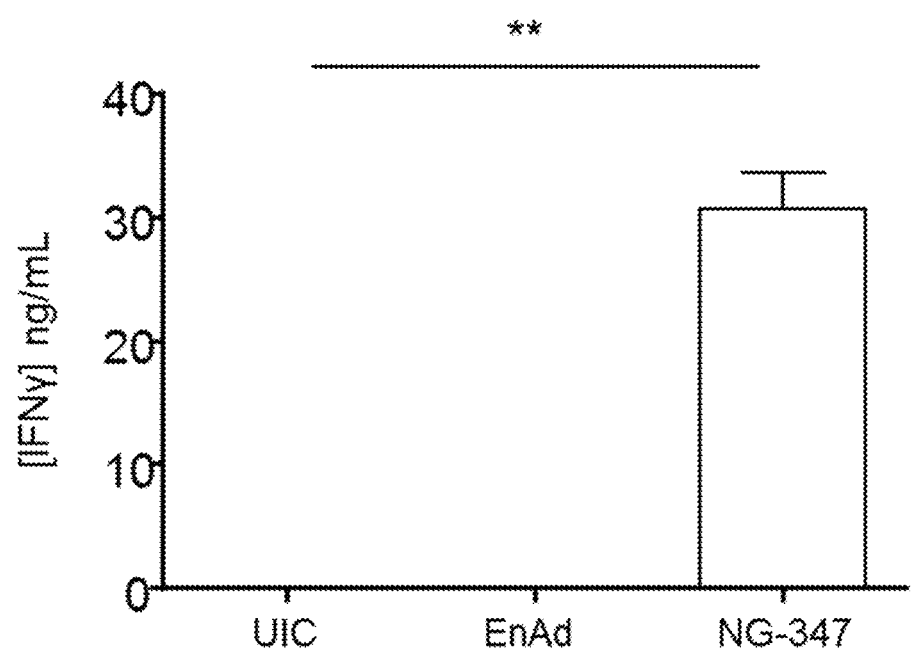
FIG. 42 shows induction of IFNγ production by human CD3+ T cells following co-culture with NG-347 infected A549 cells, but not when infection was with EnAd

In a separate experiment, A549 cells treated with NG-347 and co-cultured with human CD3+ T-cells led to upregulation of CD69 activation marker on the T-cells and secretion of IFNγ (see FIGS. 41 & 42).

Example 12

Figure 29:
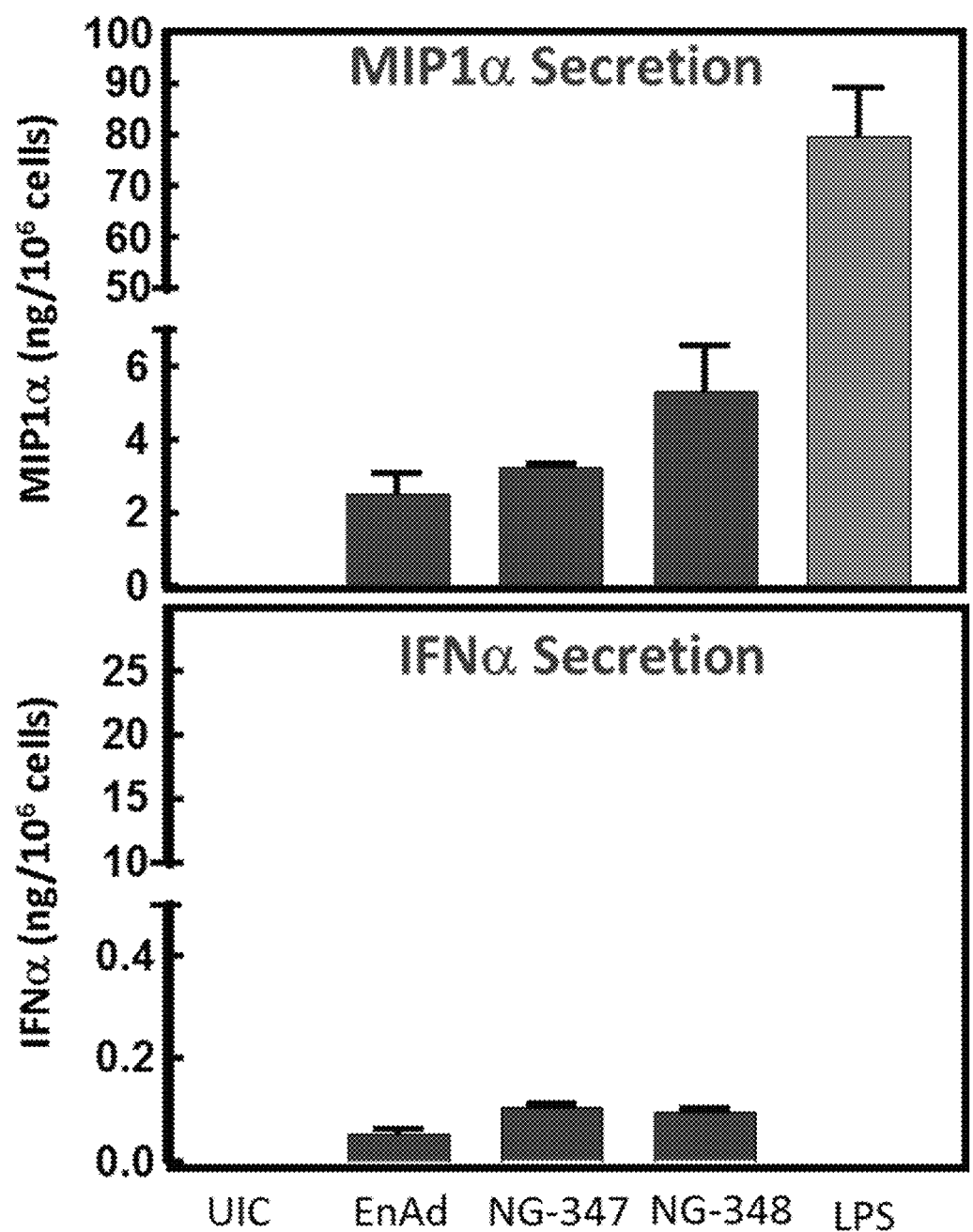
FIG. 29 shows MIP1α and IFNα secreted by human dendritic cells treated with EnAd, NG-347 or NG-348 virus particles
Figure 30:
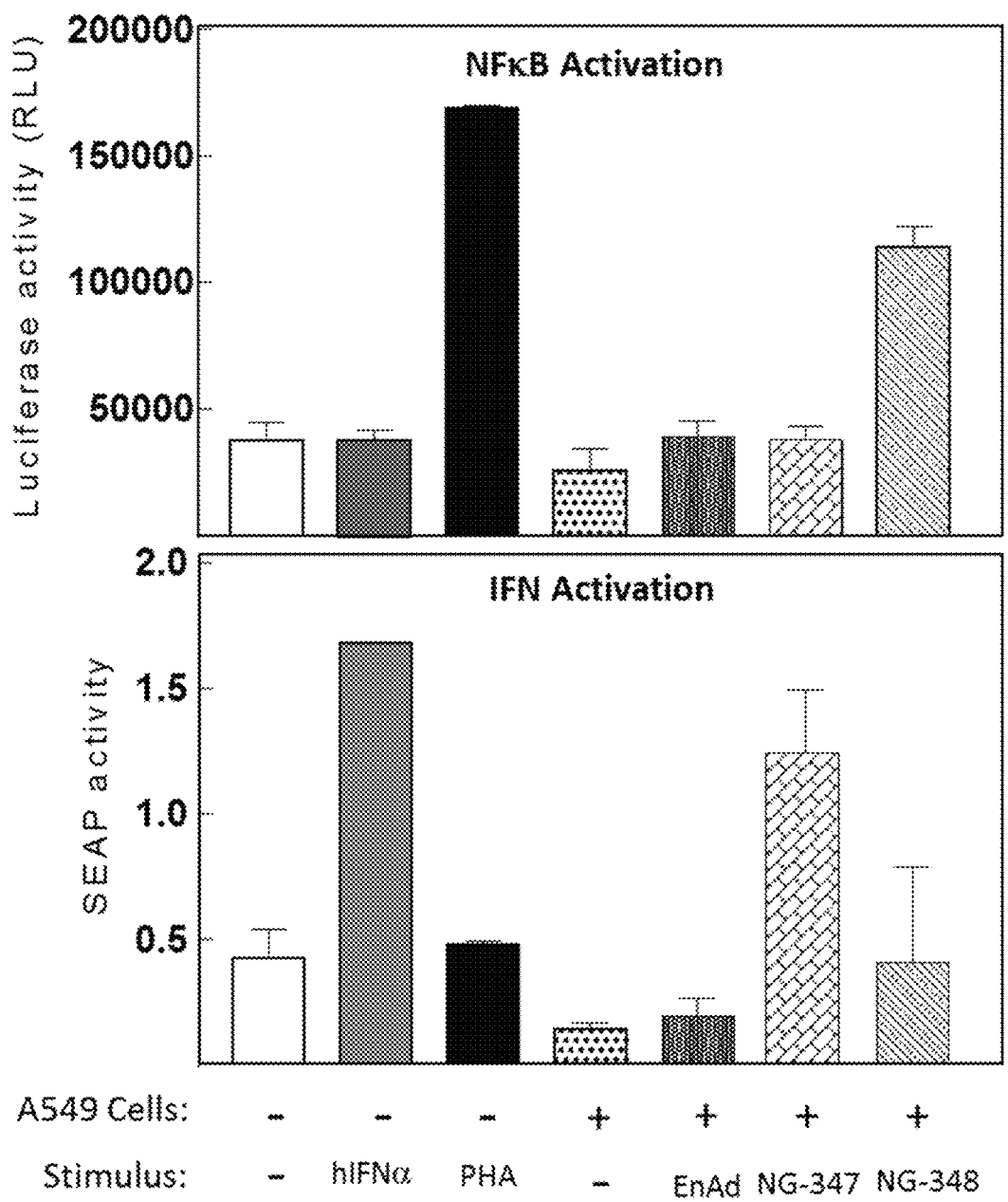
FIG. 30 shows NFκB and IFN reporter gene activation in JurkatDual reporter T-cells co-cultured with EnAd, NG-347 or NG-348 infected A549 tumour cells

CD14+ monocytic cells were isolated from PBMCs by antibody coated magnetic bead separation and cultured with human IL-4 and GM-CSF to differentiate them into dendritic cells. After 3 days of culture, the cells were treated with EnAd, NG-347 or NG-348 at 5000 ppc or left untreated. As a positive activation control, some cells were stimulated with LPS. Two days later supernatants were taken for cytokine ELISAs and cells were stained for surface activation marker expression and analysed by flow cytometry. As shown in table 9, all viruses induced upregulation of the costimulatory molecules CD80 and CD86, indicating that this previously identified particle-mediated innate immune cell activation effect was not altered by the transgene incorporation into the genomes of NG-347 and NG-348. All viruses also stimulated secretion of similar levels of MIP1α and IFNα (FIG. 29).

TABLE 9

Particle-mediated activation of human dendritic cells by EnAd, NG-347 and NG-348

| DC treatment | % CD80+ | % CD86+ |
| --- | --- | --- |
| Untreated | 3.0 | 10.4 |
| EnAd | 81.6 | 99.3 |
| NG-347 | 82.1 | 99.4 |
| NG-348 | 62.5 | 99.5 |
| LPS positive control | 97.5 | 98.5 |

Example 13

Figure 31:
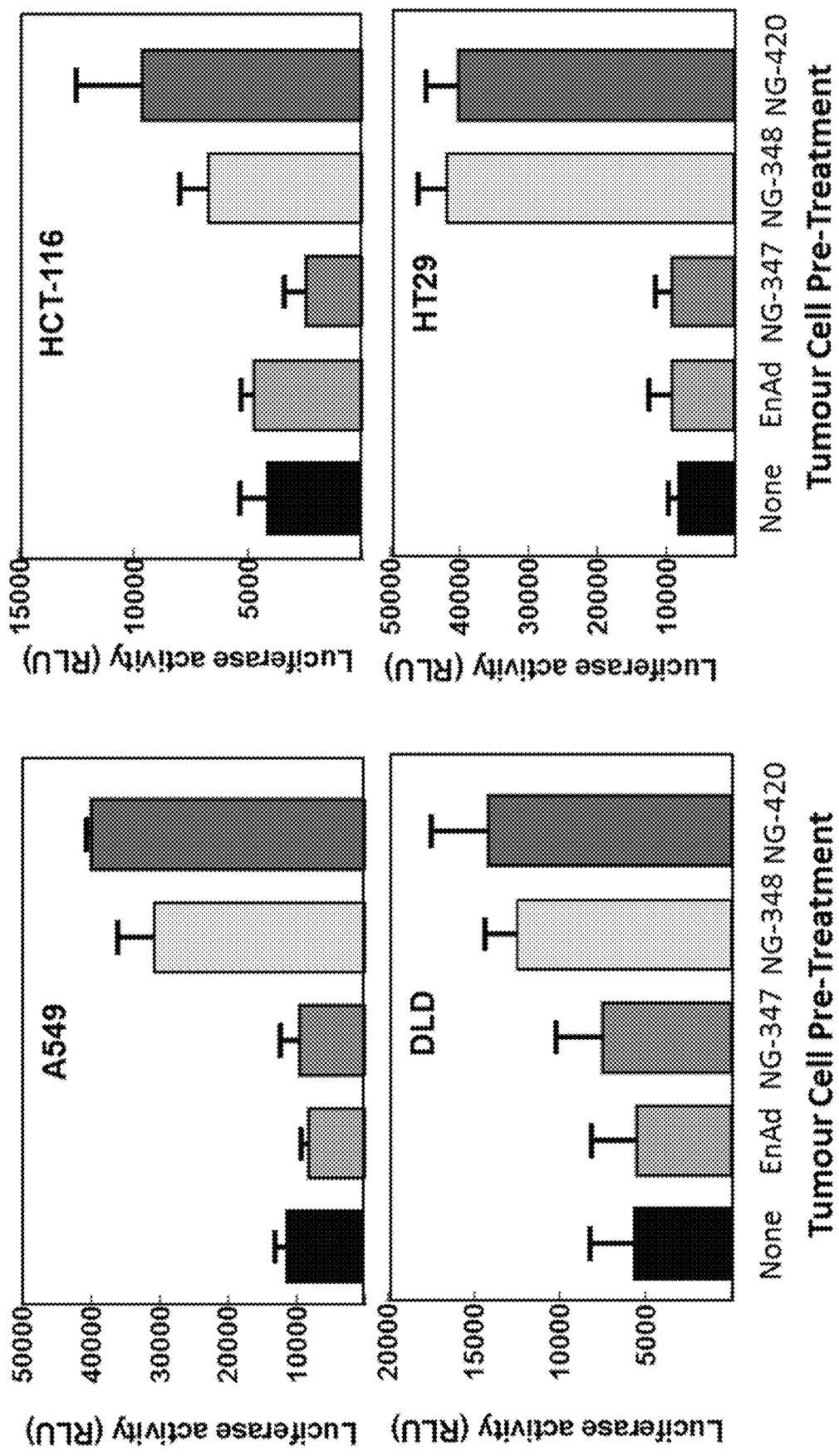
FIG. 31 shows NF-κB-luciferase reporter activity generated by JurkatDual reporter T-cells co-cultured with EnAd, NG-347, NG-348 or NG-420 treated A549 HCT-116, DLD and HT29 tumour cells

In a set of experiments, JurkatDual cells were used in co-cultures with tumour cells as a T-cell activation reporter assay for assessing functionality of transgene expression by NG-347, NG-348 and NG-420 viruses, with EnAd serving as a negative control. JurkatDual cells stably express two different reporter genes: an NFκB reporter gene producing a secreted form of luciferase which is responsive to signalling via the T-cell receptor complex and an IFNα-responsive secreted alkaline phosphatase (SEAP) reporter gene. A549 cells were pre-cultured with viruses at '10 ppc for two days, and then JurkatDual cells were added for overnight co-culture (18-24 h) and then supernatants collected for assay of luciferase and SEAP activities. As shown in FIG. 43, NG-347 infected A549 cells selectively induced SEAP production, which aligns with their production of IFNα (see FIG. 7) but did not induce luciferase activity. In contrast, NG-348 which expresses the membrane anti-CD3-ScFv to activate the T-cell receptor complex induced luciferase but not SEAP. In another experiment A549 lung carcinoma cells and HCT-116, HT-29 & DLD colon carcinoma cells were pre-cultured for 48 hours with 10 ppc of EnAd, NG-347, NG-348 or NG-420 viruses before co-culturing with JurkatDual cells overnight, with supernatants tested for levels of luciferase to indicate level of activation induced. As shown in FIG. 31, all four tumour cell types cultured with NG-348 or NG-420 viruses, which encode cell surface anti-CD3-ScFv, activated the JurkatDual cells whereas EnAd and NG-347 did not, with levels of luciferase similar to that of uninfected tumour cell controls (UIC).

Figure 32:
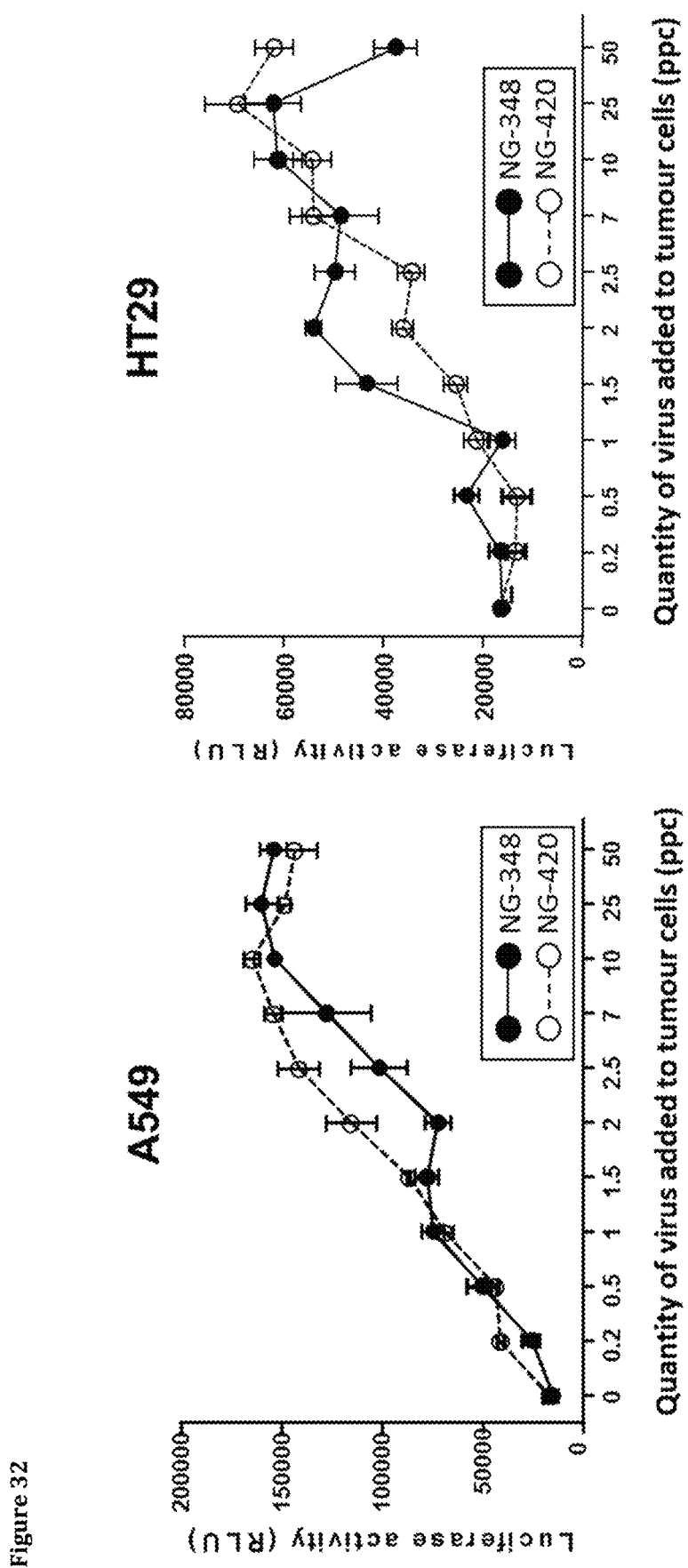
FIG. 32 shows NF-κB-luciferase reporter activity generated by JurkatDual cells co-cultured with either A549 or HT29 tumour cells infected with virus NG-348 and virus NG-420 as a function of virus particles added

In another experiment, A549 or HT-29 tumour cells were pre-cultured with different amounts of either NG-348 or NG-420 before adding the JurkatDual cells and measuring their luciferase secretion. The data in FIG. 32 show that activation of the NFκB activity in JurkatDual cells is dependent on the dose of virus used to treat the tumour cells with.

Example 14

Figure 33:
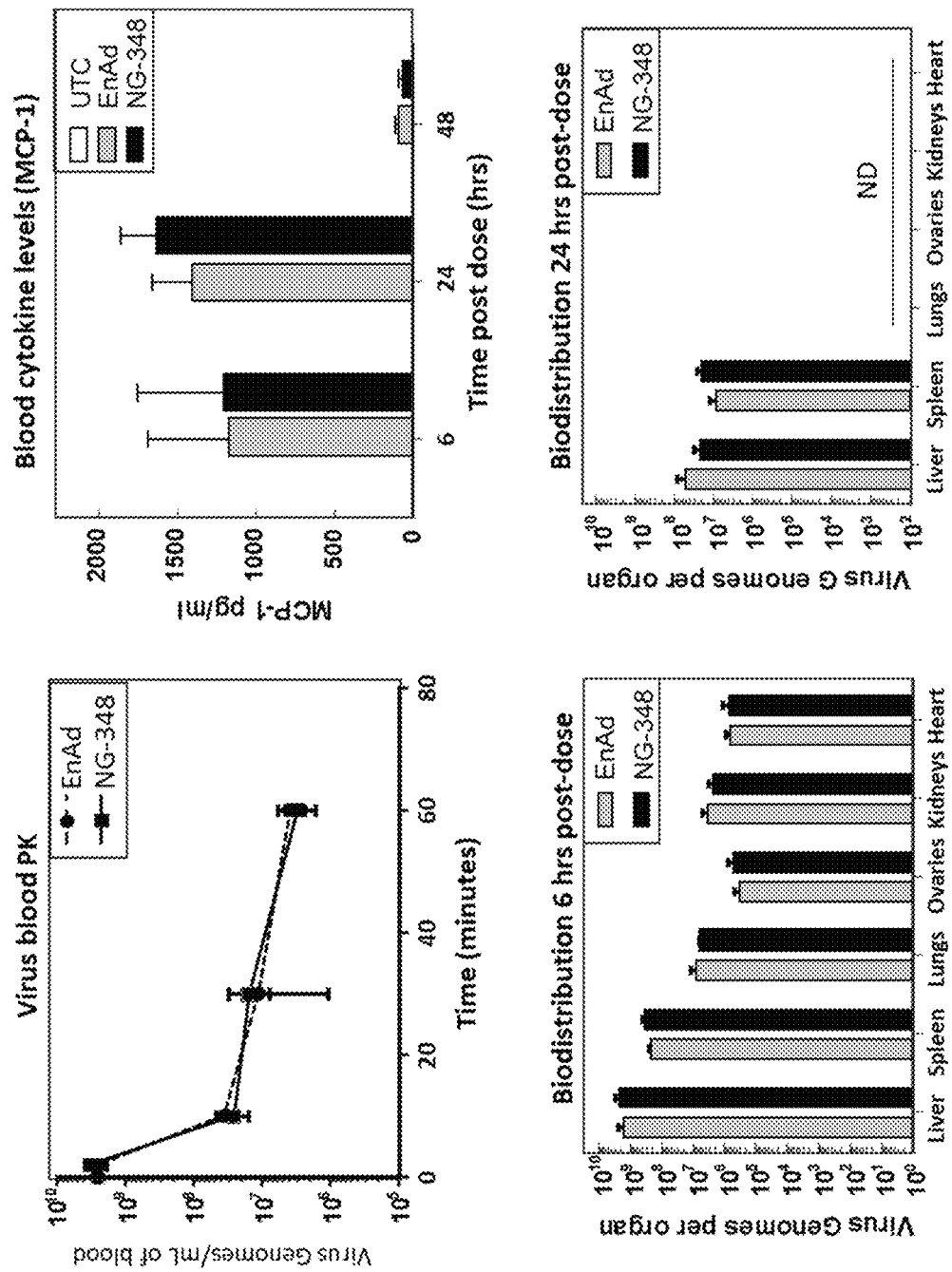
FIG. 33 shows the pharmacokinetics of EnAd and virus NG-348 in blood; blood cytokine levels after exposure to EnAd or virus NG-348; tissue biodistribution of EnAd or NG-348 viruses 6 or 24 hours after IV administration to CD1 mice

The in vivo pharmacokinetic, biodistribution and particle-mediated systemic cytokine induction activities of EnAd and NG-348 following IV dosing in immunocompetent CD1 mice were compared, Mice were dosed intravenously with $5 \times 10^9$ particles of either EnAd or NG-348 and bled 2, 10, 30, 60 and 120 minutes post dosing. Whole blood was DNA extracted and analysed by qPCR for levels of virus genome (FIG. 33). Clearance of both viruses from the blood followed similar kinetics. Similarly, the induction of MCP-1 cytokine response (a measure of particle-mediated activation of innate immune such as liver Kupffer cells) was also similar for both viruses, as were the tissue biodistribution patterns (FIG. 33).

Example 15

Figure 34:
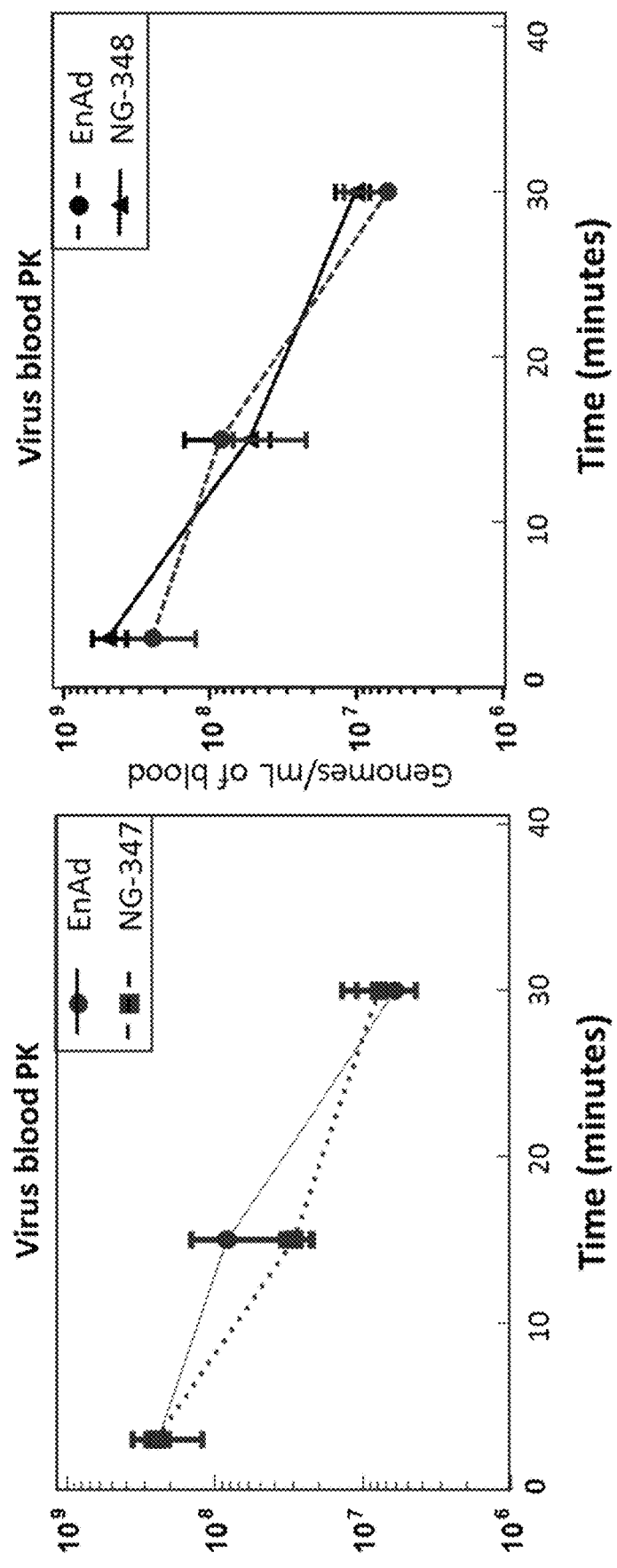
FIG. 34 shows the pharmacokinetics in blood of EnAd, NG-347 and NG-348 viruses following IV administration to CB17-SCID mice bearing a subcutaenous HCT-116 tumour xenograft.
Figure 35:
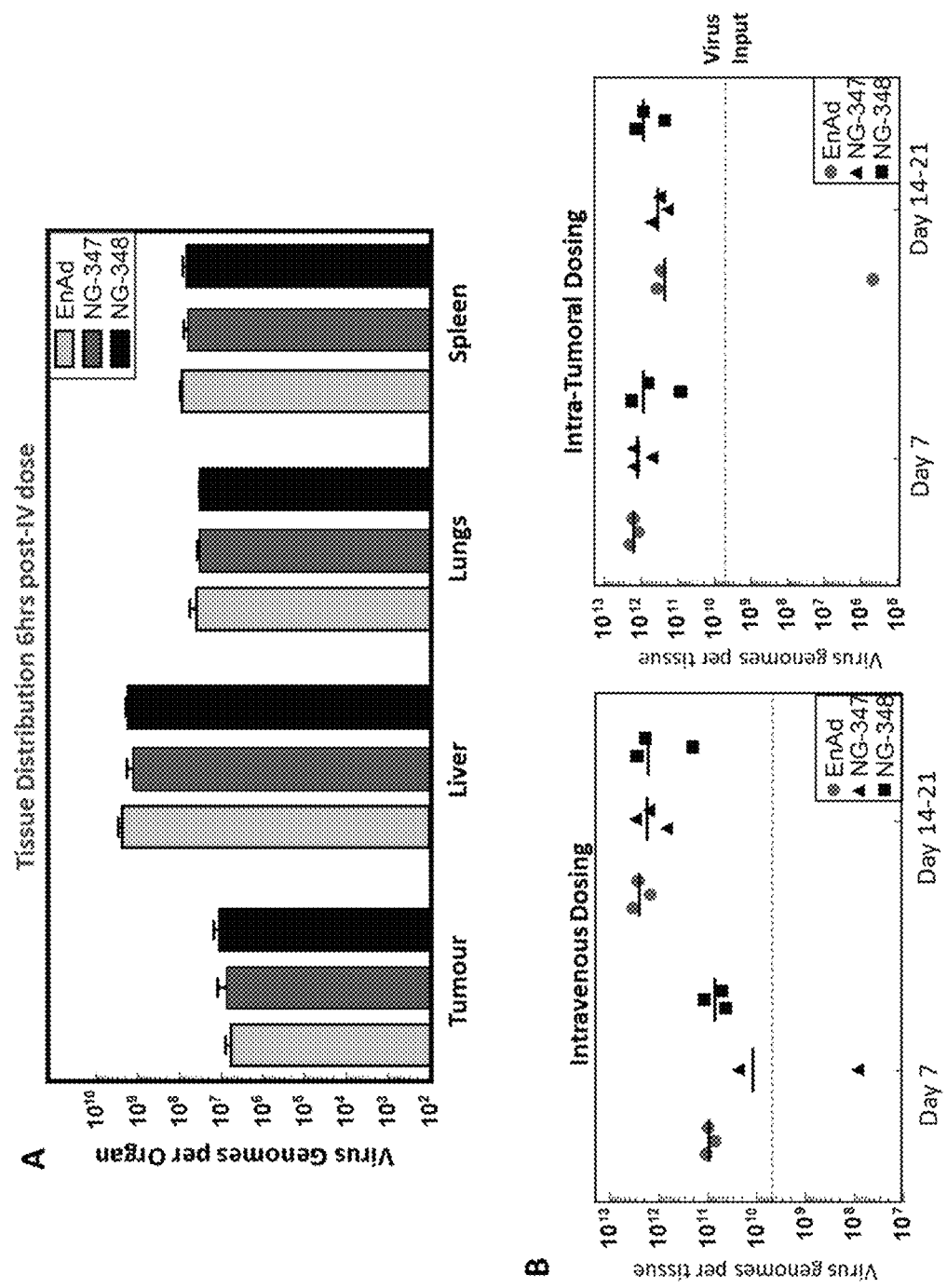
FIG. 35 shows the tissue distribution of EnAd, NG-347 and NG-348 viruses 6 hours post intravenous dosing in tumour-bearing CB17-SCID mice, and virus genomes in HCT-116 tumour xenografts at day 7 and day 14-21 following intravenous or intra-tumoral dosing of EnAd, NG-347 and NG-348

CB17 SCID mice were implanted subcutaneously with HCT116 cells and injected intratumourally (IT) or intravenously (IV) with EnAd, NG-347 or NG-348 viruses ($5 \times 10^9$ virus particles), or control, once tumours were greater than 70 mm$^3$. For the IV dosed mice, blood samples were taken from three mice from each group 3, 15 and 30 minutes after IV dosing, DNA extracted and the level of virus genomes in the blood assessed by qPCR (pharmacokinetics [PK] analysis). Data (FIG. 34) show that NG-347 and NG-348 have similar PK to EnAd (and to each other). After 6 hours, tumours, livers, lungs and spleens were resected from 3 mice from each group. Homogenised tissues were DNA extracted and analysed for level of virus genomes by qPCR (biodistribution analysis). Data (FIG. 35A) show similar tissue biodistribution for the three viruses. After 7 days or 14-21 days, tumours were excised from three mice from each group and homogenized to produce a tumour lysate which was used to prepare both DNA and RNA. Level of virus genomes in the tumours at the two time points were measured by qPCR analyses of the extracted DNA. Data (FIG. 35B) show that tumours from both IV and IT dosed mice have levels of virus genomes higher than the amount of virus dosed, indicating virus replication in the tissue, with IT dosing giving higher genome levels than IV at day 7, but both being similarly high at the 14-21 day timeframe. All three viruses replicated to similar levels.

Figure 36:
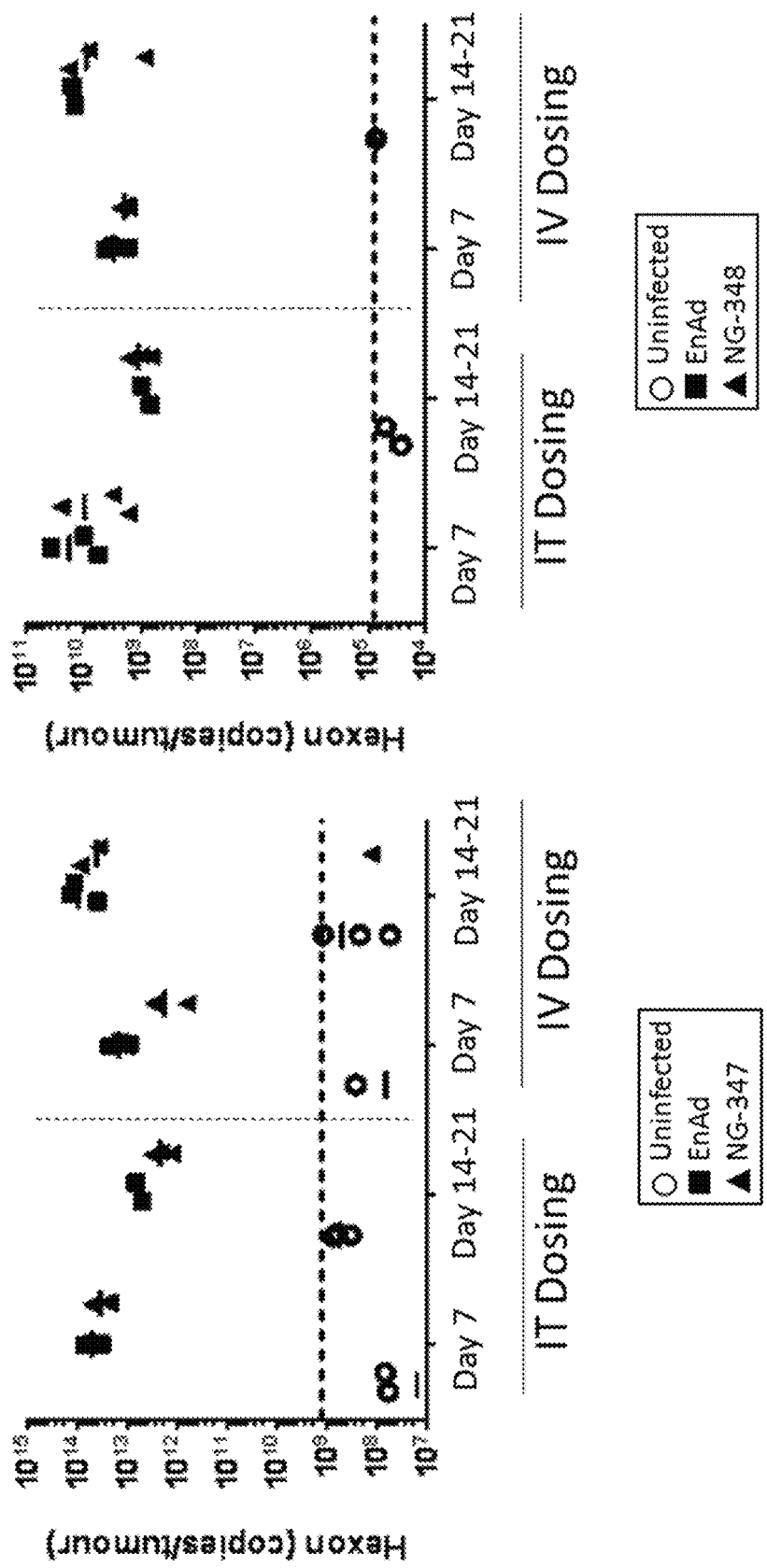
FIG. 36 shows virus hexon mRNA generated in HCT-116 tumour xenografts by EnAd, NG-347 or NG-348 viruses on day 7 or 14-21 following intravenous or intra-tumoral dosing
Figure 37:
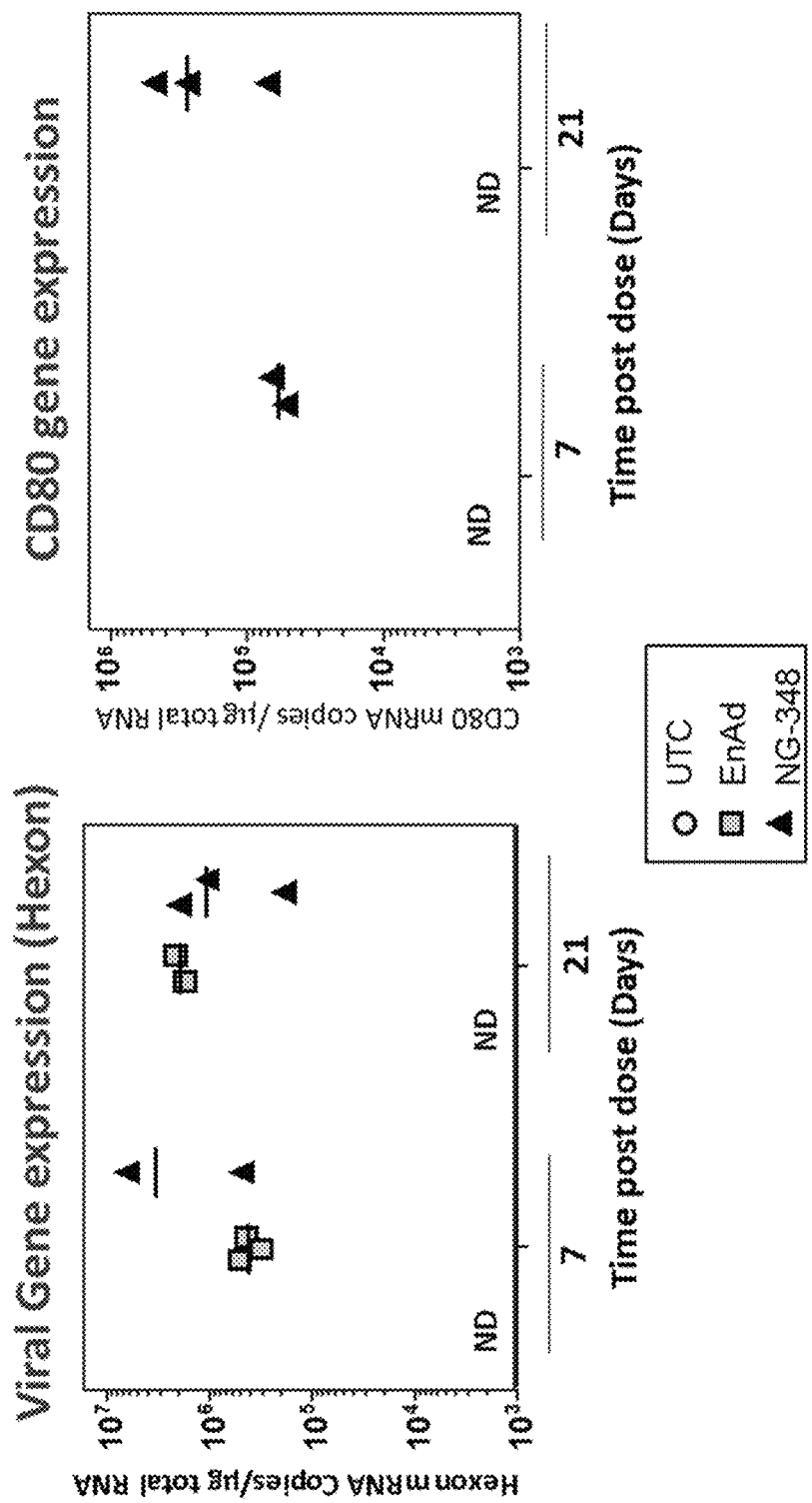
FIG. 37 shows mRNA levels for hexon and CD80 transgene in HCT-116 tumour xenografts 7 or 21 days following intravenous dosing with virus NG-348
Figure 38:
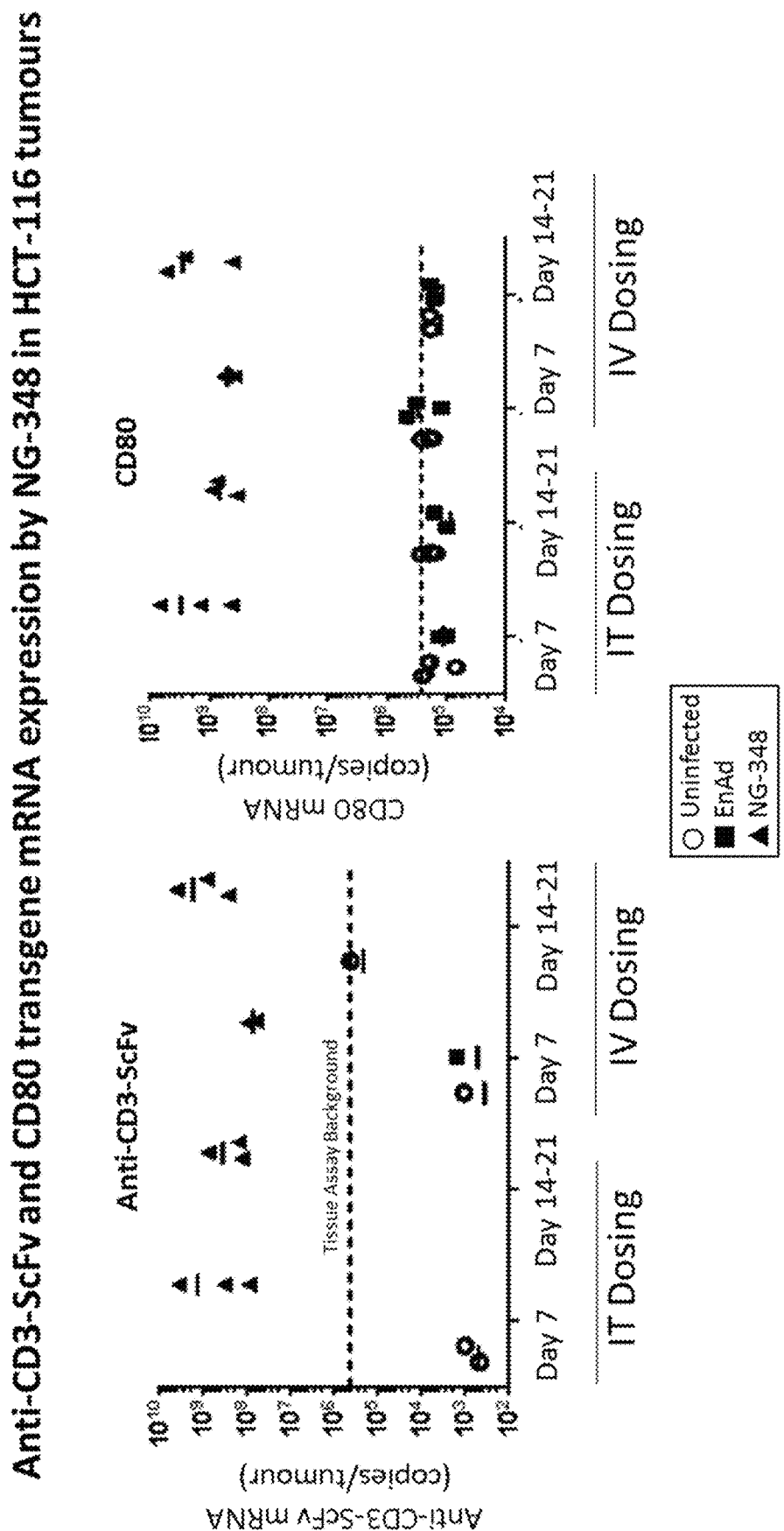
FIG. 38 shows mRNA levels for a transgenes encoding anti-CD3 scFv and CD80 in HCT-116 tumour xenografts 7 or 14-21 days following IV dosing with virus NG-348
Figure 39:
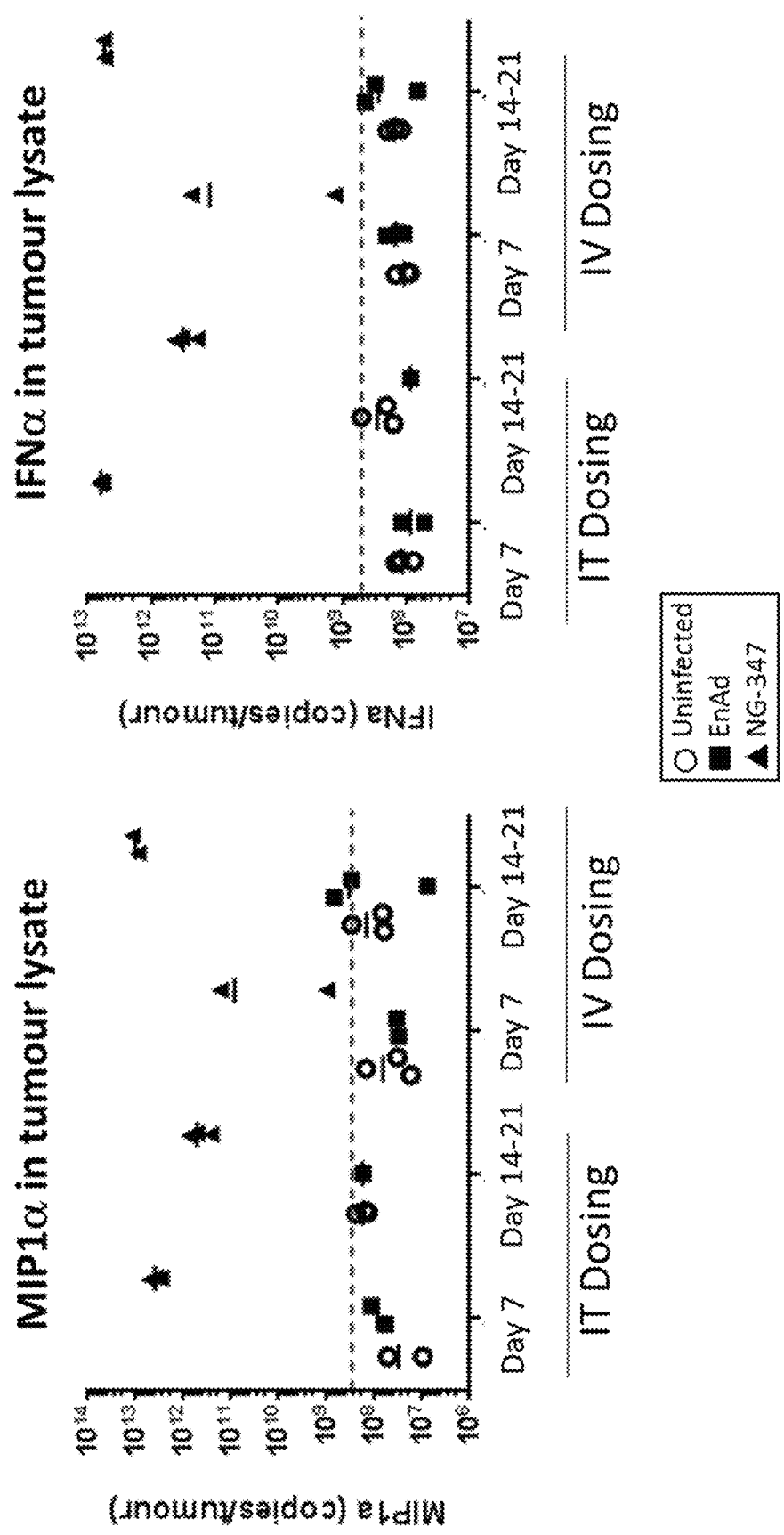
FIG. 39 shows mRNA levels of MIP1α and IFNα transgenes in HCT-116 tumour xenografts 7 or 14-21 days following intravenous dosing with virus NG-347

Similarly, levels of virus hexon mRNA in tumour lysates detected by RT-qPCR were comparable between EnAd, NG-347 and NG-348 at both time points tested (FIGS. 36 and 37). Similar levels of anti-CD3-ScFv and CD80 mRNA were detected at both time points and both dosing routes for NG-348 treatment, with only assay background readings with EnAd dosing (FIGS. 37 & 38). MIP1α and IFNα mRNA levels were also selectively detected following NG-347 dosing, either IT or IV (FIG. 39).

Figure 40:
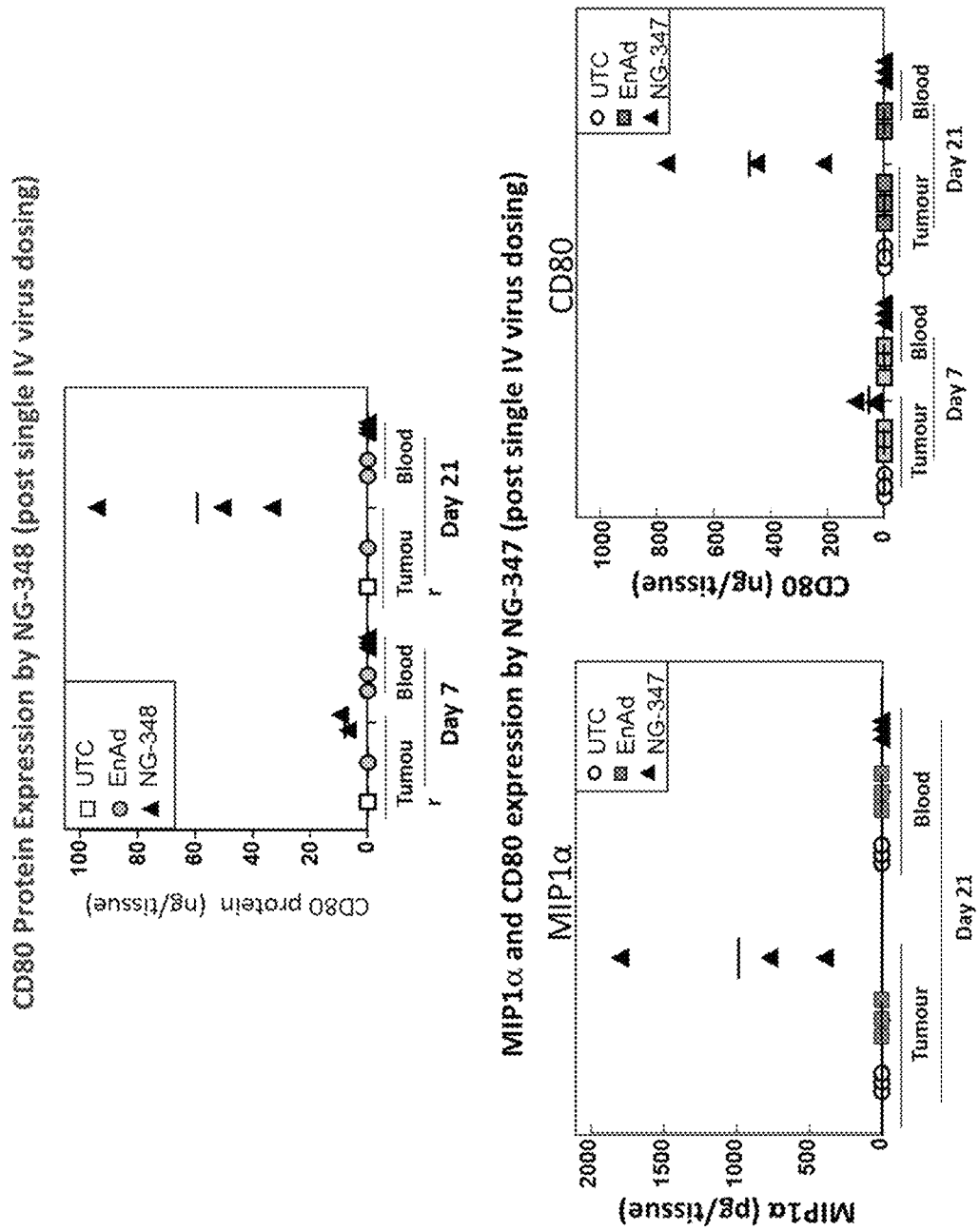
FIG. 40 shows CD80 protein expression in HCT-116 tumour xenografts 7 and 21 days following an intravenous dose of virus NG-348; and shows MIP1α and CD80 protein expression in HCT-116 tumours following an intravenous dose of virus NG-347.

Levels of CD80 protein encoded by both NG-347 and NG-348, and MIP1a protein encoded by NG-347 were measured in tumour lysates using specific ELISAs. The data in FIG. 40 show that following the single IV virus dose, both proteins could also be detected selectively in tumour extracts. Neither protein was detected in blood samples from the same mice.

Example 16

To evaluate the activity and tumour cell dependency of NG-348 virus in vivo, different combination of human PBMCs ($5\times10^7$ cells), A549 human tumour cells ($5\times10^6$) and either EnAd or NG-348 (at $5\times10^9$ ppc) were injected into the peritoneum of immunodeficient SCID-beige mice, with viruses or control (saline) being dosed within 15 minutes after injection of the cells. After 3 days, the peritoneal cavity was lavaged with 5 mL of saline and recovered cells were analysed by flow cytometric analyses with a panel of T-cell activation markers (CD25, CD69 and HLA-DR) to assess levels of T-cell activation, following gating on the CD3+ T-cell population. Data from two separate experiments (Table 10) demonstrate that NG-348 selectively leads to human T-cell activation in vivo in a tumour cell dependent manner.

TABLE 10

In vivo activation of human T-cells in A549 tumour bearing mice by NG-348

| Group | Virus | Tumour | N | % CD25+ | % CD69+ | % DR+ | % CD25+, CD69+ | % CD25+, DR+ |
|---|---|---|---|---|---|---|---|---|
| | | | | Experiment 1 | | | | |
| 1 | EnAd | Saline | 2 | 1.9 | 1.6 | 7.7 | 0.2 | 0.3 |
| | | | | 2.3 | 3.0 | 9.1 | 0.5 | 0.6 |
| 2 | EnAd | 5 × 10⁶ A549 cells | 2 | 4.2 | 6.2 | 8.4 | 0.8 | 1.4 |
| | | | | 2.9 | 5.5 | 8.4 | 0.3 | 0.4 |
| 3 | NG-348 | Saline | 1 | 3.4 | 2.6 | 9.2 | 0.5 | 0.8 |
| 4 | NG-348 | 5 × 10⁶ A549 cells | 2 | 35.8 | 50.4 | 26.3 | 22.4 | 16.4 |
| | | | | 36.6 | 42.2 | 19.2 | 18.0 | 12.2 |
| | | | | Experiment 2 | | | | |
| 1 | Saline | Saline | 1 | 25.6 | 37.3 | 14.8 | 14.1 | 7.08 |
| 2 | EnAd | Saline | 2 | 6.5 | 17.8 | 5.50 | 3.58 | 1.01 |
| | | | | 7.3 | 18.2 | 6.1 | 3.46 | 1.49 |
| 3 | NG-348 | Saline | 2 | 10.2 | 26.7, | 7.7 | 6.73 | 2.16 |
| | | | | 6.5 | 18.3 | 6.0 | 3.61 | 1.44 |
| 4 | Saline | 5 × 10⁶ A549 cells | 2 | 28.4 | 54.4, | 13.3 | 22.3 | 8.54 |
| | | | | 22.7 | 51.1 | 15.0 | 17.5 | 7.72 |
| 5 | EnAd | 5 × 10⁶ A549 cells | 1 | 13.2 | 29.4 | 5.1 | 7.84 | 1.62 |
| 6 | NG-348 | 5 × 10⁶ A549 cells | 3 | 34.4 | 58.9, | 12.5 | 27.2 | 9.07 |
| | | | | 29.6 | 59.2, | 9.8 | 23.3 | 7.5 |
| | | | | 56.4 | 85.0 | 17.0 | 52.7 | 14.2 |

Examples describing virus cloning (HSV-1 and Vaccinia virus) to express CD3scFv-2A-CD80 transgene and evaluation of biological properties Example 17: Cloning of Herpes Simplex Virus-1 (HSV-1) to Express the CD3scFv-2A-CD80 Transgene An oncolytic HSV-1 virus was produced using standard cloning methodologies, with both copies of ICP34.5 deleted, with a transgene cassette inserted into the $U_L 39$ locus encoding the membrane-anchored anti-human CD3e ScFv cDNA; a high efficiency self-cleavable P2A peptide sequence (SEQ ID NO. 94); human CD80 cDNA sequence and a 3" polyadenylation sequence (SEQ ID NO. 99), under control of the CMV immediate early promoter and enhancer (termed CD3scFv-2A-CD80). Cloning of the recombinant HSV-1 was based on three steps: Initially the CD3scFv-2A-CD80 transgene was cloned into a shuttle plasmid by restriction and ligation. The shuttle vector was then inserted into a bacterial artificial chromosome containing HSV-1 by homologous recombination, virus DNA was isolated and then the virus was rescued by transfection of the DNA into Vero cells. Plaques apparently containing recombinant viruses were selected and used to infect new Vero cells, for amplification. In total four plaques of CD3scFv-2A-CD80 transgene-containing HSV-1 (HSV-X) were obtained (No's 5.1, 8.1, 9.1 & 9.3) and amplified for functional analysis.

Example 18: Transgene Expression and T Cell Activation By HSV-X (i) Transgene Expression in Vero Cells Vero cells were seeded (150,000 cells/well, 24-well plate) 24 hours prior to infection with HSV-X-5.1, HSV-X-8.1, HSV-X-9.1 and HSV-X-9.3 (100 µl from crude virus preparation, titre unknown). As a control, HSV that expresses only GFP, was also tested. Infected cells were harvested 24 h post infection and stained with anti-human CD80-APC conjugated antibody (1:200 dilution). Expression of the GFP reporter and of CD80 was evaluated by Flow cytometry, measuring the geometric mean fluorescence intensity and the percentage of positive cells, for each parameter (see FIG. 46 A-E). Expression of CD80 was only observed only in cells infected with HSV-X-8.1.

(ii) T Cell Activation Upon Infection of Vero Cells

Additionally, Vero cells were seeded (50,000 cells/well, 96-well plate) 24 hours prior to infection with HSV-X-5.1, HSV-X-8.1, HSV-X-9.1 and HSV-X-9.3 (20 µl from crude virus preparation, titre unknown) or HSV-GFP. Cryopreserved peripheral blood lymphocytes were thawed and added to HSV-X-infected Vero cells (150,000 cells/well), 24 hours post infection. The non-adherent lymphocytes and cellular supernatants were harvested 24 hours later. Supernatant samples were assessed for IFNγ secretion (see example 8 and Figure D4). The T cells were, and stained with anti-human CD69-APC conjugated antibody (1:200 dilution). CD69 expression on lymphocytes was evaluated by flow cytometry, by measuring the geometric mean fluorescence intensity and the percentage of positive cells (see FIG. 46 F-H). T cell activation was only observed upon stimulation with cells infected with HSV-X-8.1, which confirms functional expression of the transgene.

(iii) Evaluation of Transgene Expression in Tumour Target Cells

HSV-X-8.1 was subjected to two rounds of plaque purification, and 8 subclones (1-8) were isolated and amplified. HT-29 colon and SKOV ovarian human tumour cells were seeded in 96 well plates (10,000/well) 24 hours prior to infection with dilutions of HSV-X-8.1 subclones ($10^{-2}$, $10^{-2}$ dilutions, unknown titre). HSV-GFP was included as control. In parallel, cryopreserved peripheral blood lymphocytes were thawed and left to rest over night at 37° C. Selection of T-cells was performed with a negative isolation kit, and purified T-cells were added to HSV-X-infected HT-29 or SKOV cells (50,000/well). The non-adherent T cells were harvested 24 hours later, and stained with anti-human CD69-APC conjugated antibody. T-cell activation was evaluated by flow cytometry (see FIG. 47. All 8 subclones were able to induce activation of T-cells as assessed by CD69 upregulation in tumour cells. Differences in T cells activation can be attributed to differences in the virus titres of the HSV-X-8.1 subclones, which was observed by differences in GFP expression in infected cells (data not shown).

Figure 48A:
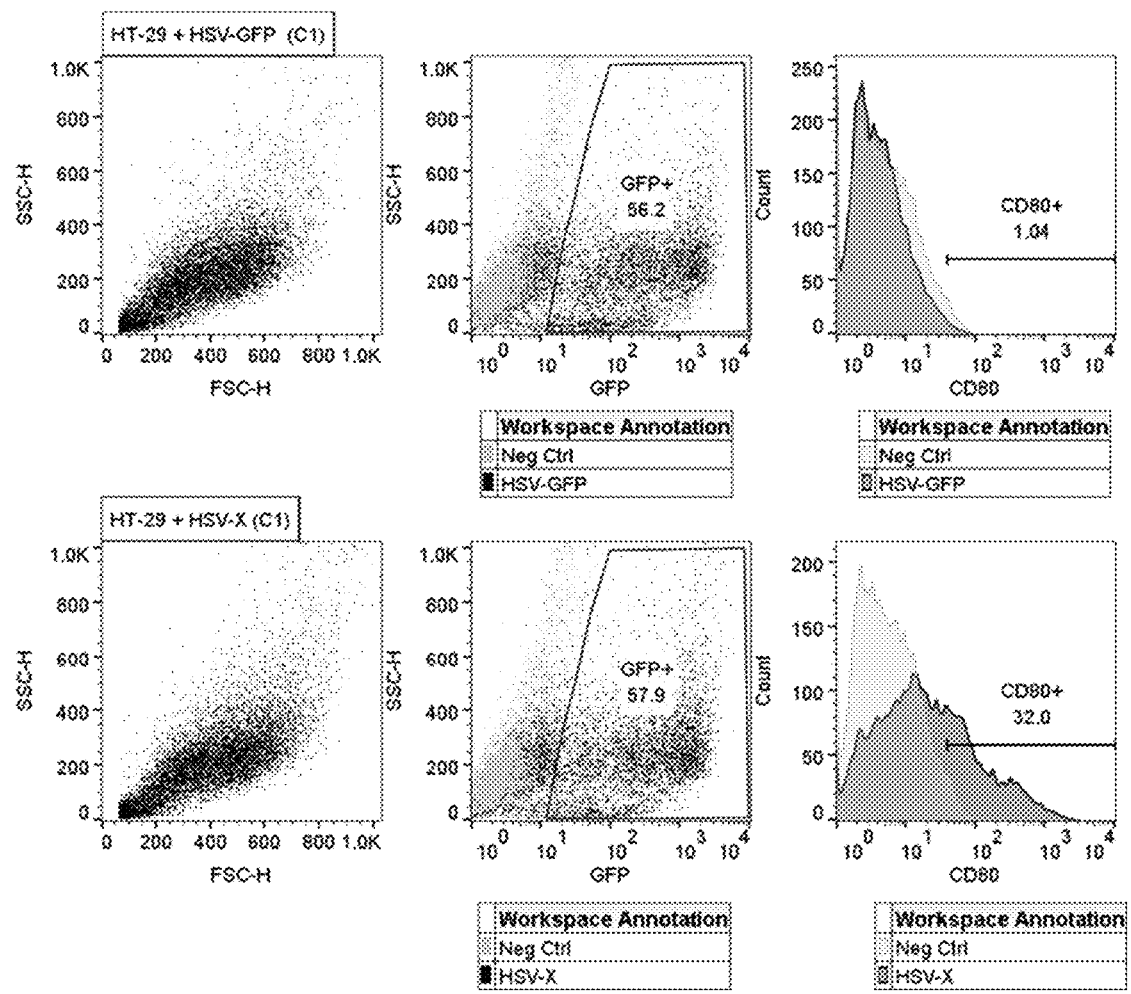
FIG. 48A-B show the evaluation of expression of CD80 and GFP in tumour target cells by flow cytometry analysis.
Figure 48A:
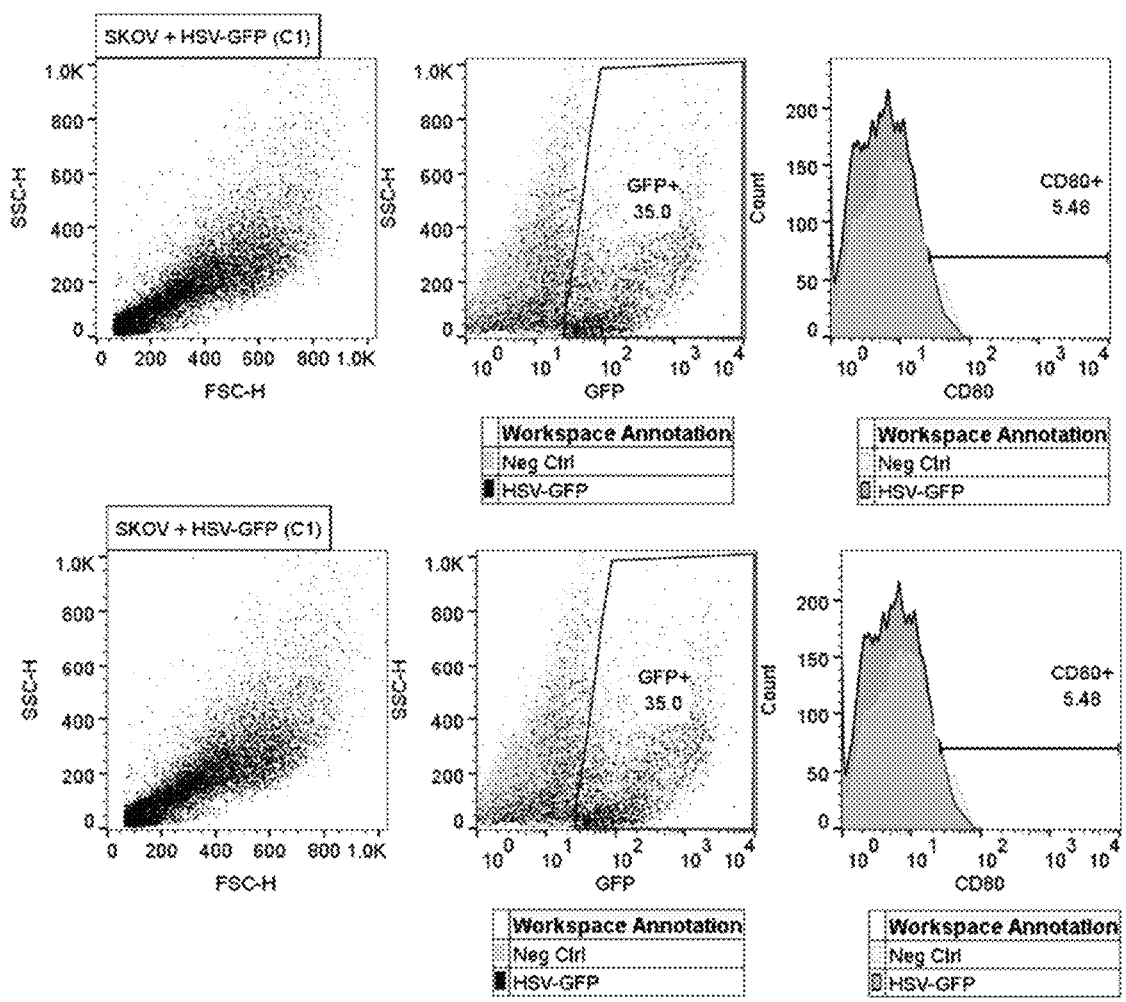
Figure 48B:
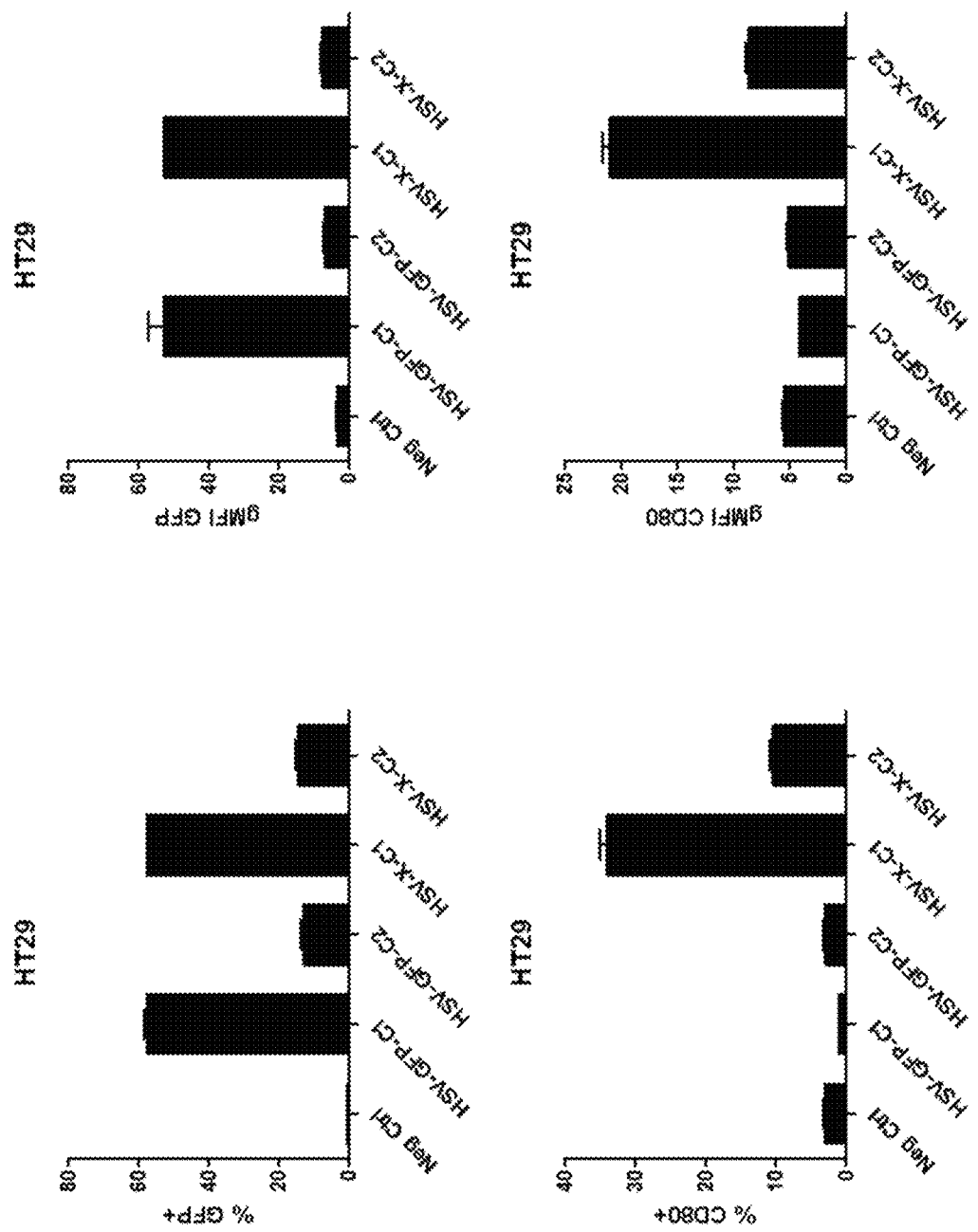
Figure 48B:
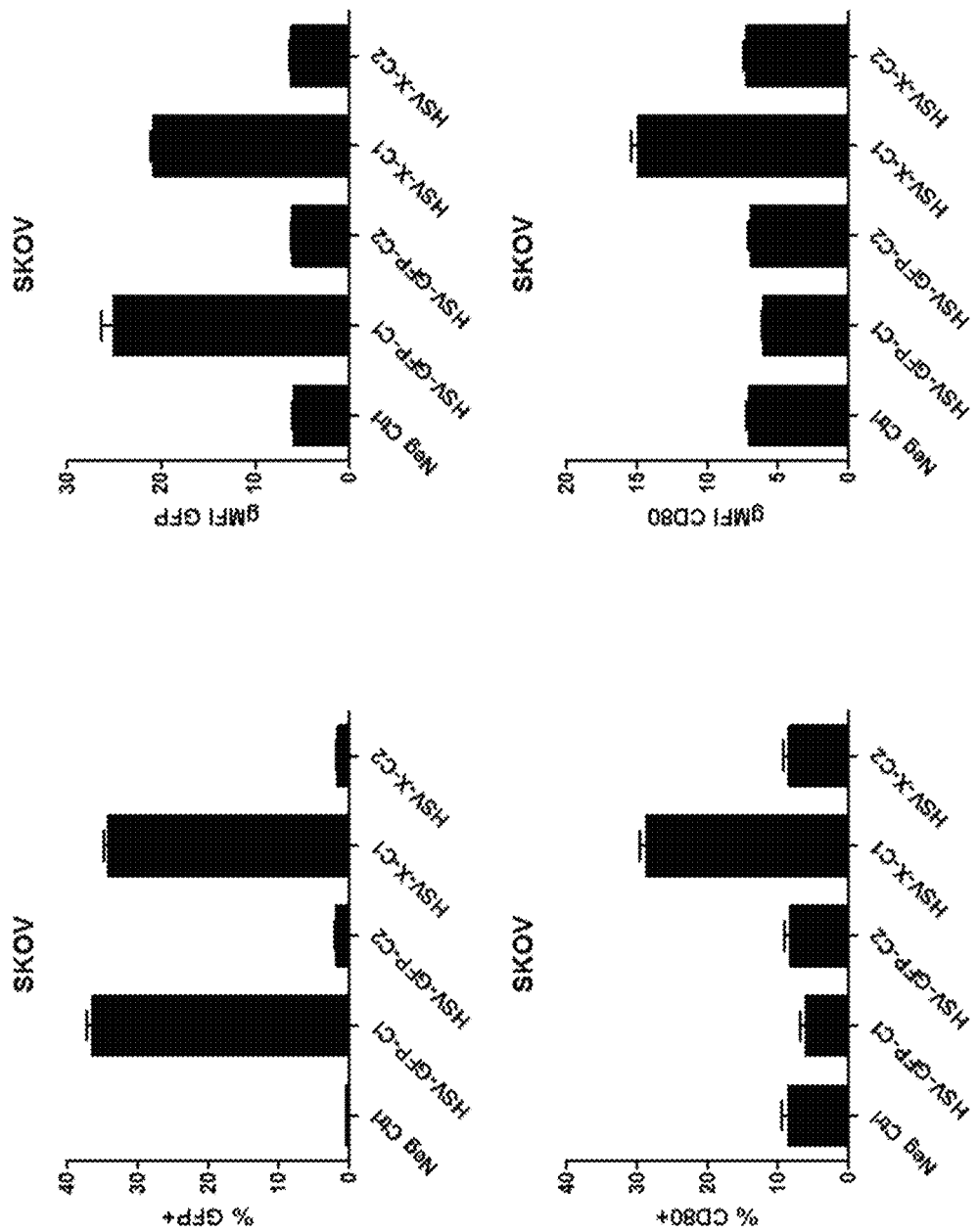

HT-29 and SKOV tumour cells were also seeded in 24 well plates (200.000/well) infected with HSV-GFP or HSV-x-8.1.8 (subclone 8) at different virus doses (Concentration 1 (C1)=$4^3$ TCID50/well, Concentration 2 (C2)=$4^2$ TCID50/well). Expression of CD80 and GFP (FIG. 48A-B) was evaluated by flow cytometry.

Figure 49A:
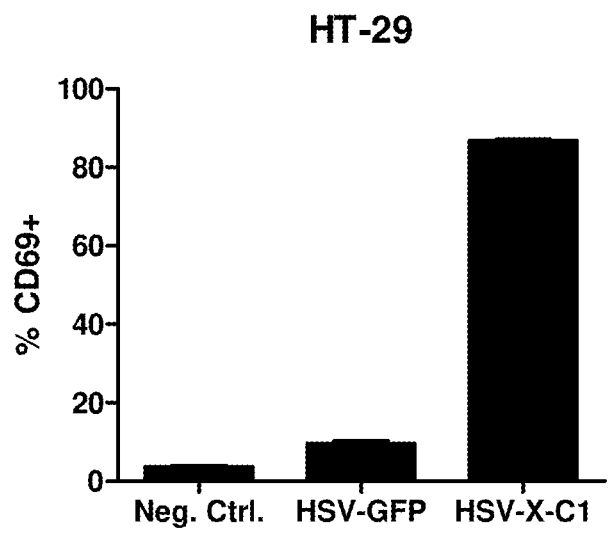
FIG. 49A-B shows expression of CD69 measured by flow cytometry.
Figure 49B:
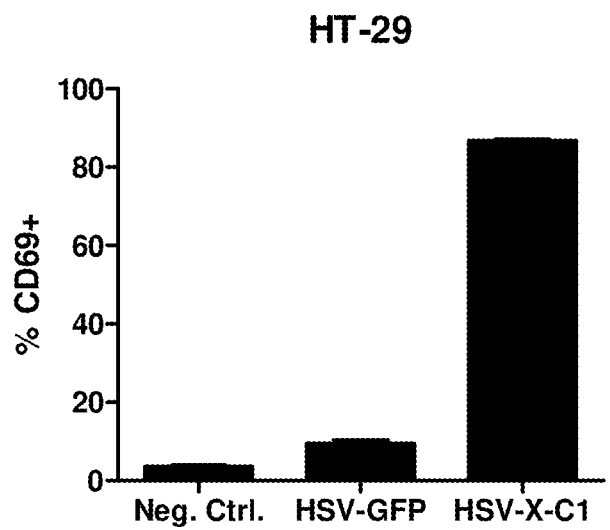

In an additional experiment, HT-29 cells were seeded in a 96-well plate (40.000 cells/well) 24 hours prior to infection with HSV-GFP or HSV-X at Concentration 1 (C1=$4^3$ TCID50/well). T cells were added as described previously, and harvested 24 hours later. Expression of CD69 was measured by flow cytometry (FIGS. 49A-B), and IFNγ production was measured by ELISA (FIG. 58D)

Figure 50:
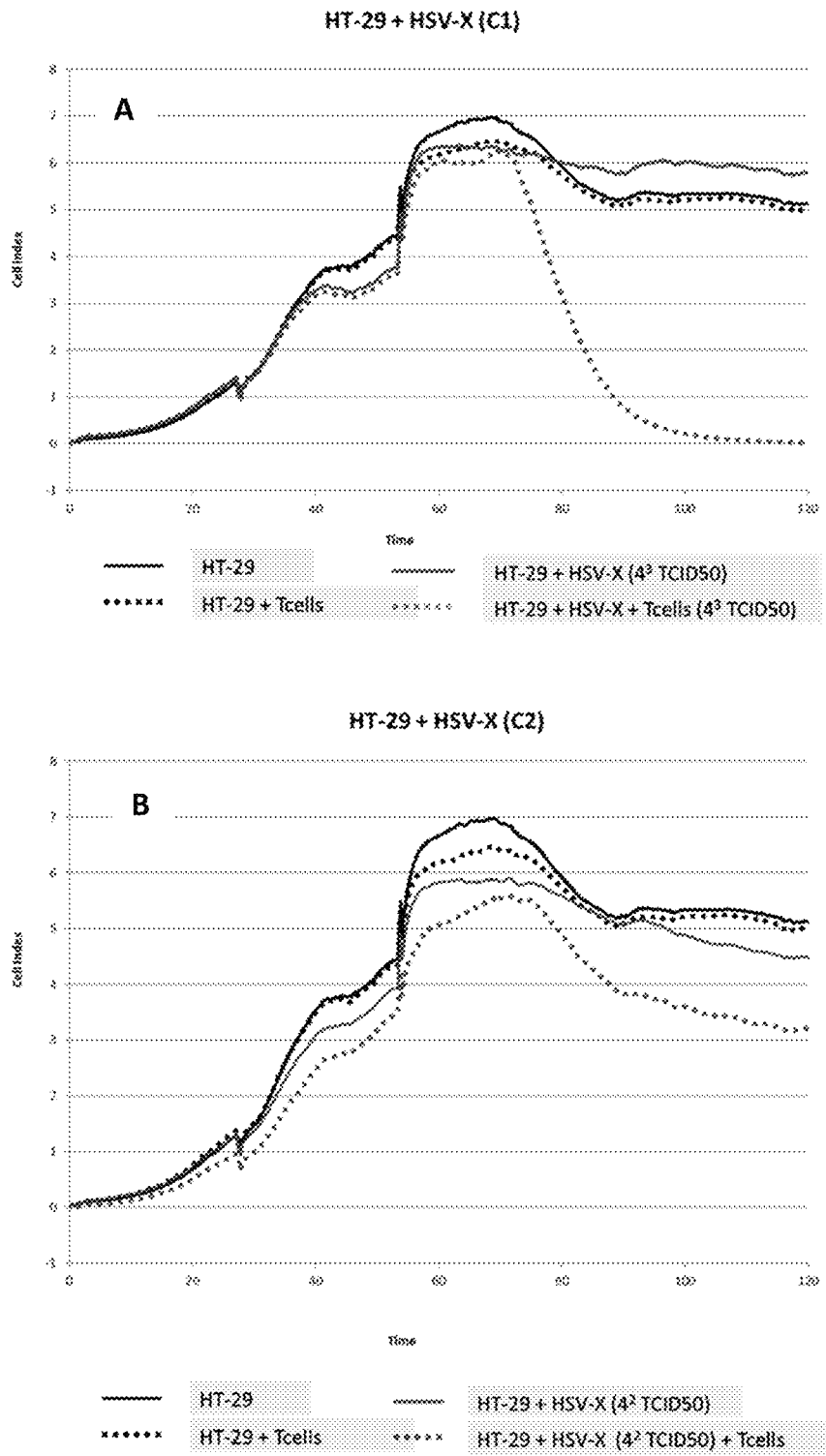
FIG. 50 A-C shows T-cell mediated killing was evaluated with XCelligence for a period of 5-6 days
Figure 50C:
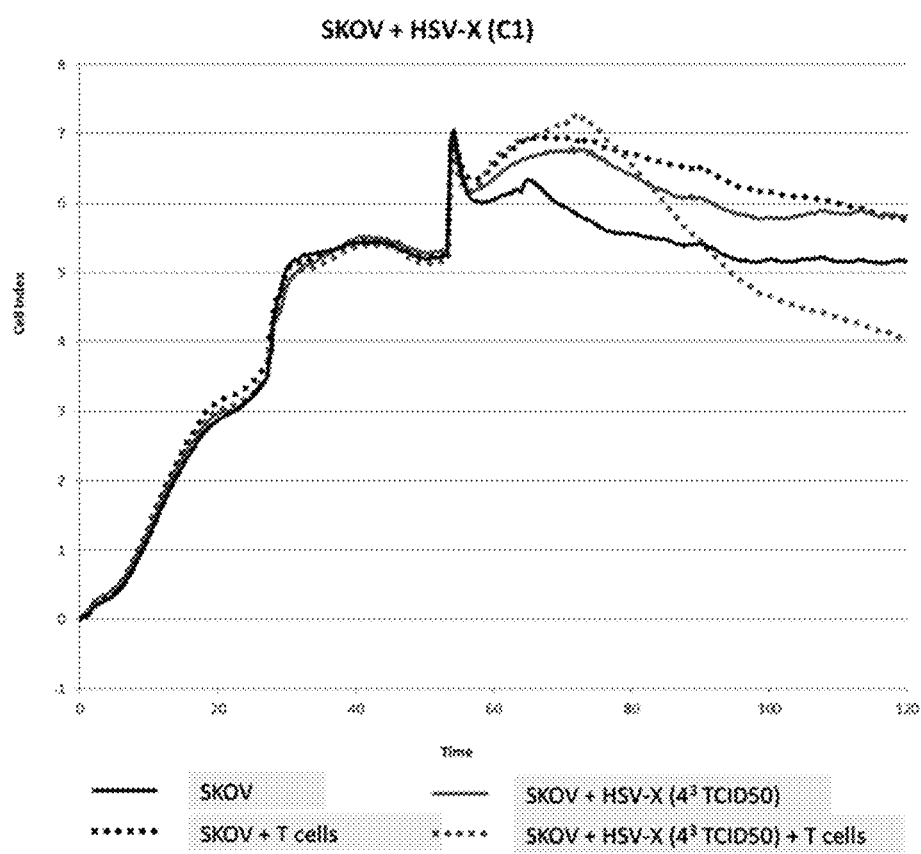

(iv) Evaluation of the Ability of HSV-X-8.1 to Activate T-cell Mediated Killing of Cancer Cells HT-29 and SKOV tumour cells were seeded on 16 well-plates (20,000 cells/well), 24 hours before infection with HSV-X-8.1.8 (Concentration 1 (C1)=$4^3$ TCID50/well, Concentration 2 (C2)=$4^2$ TCID50/well). Cryopreserved Peripheral blood lymphocytes were thawed and left to rest over night at 37° C. Selection of T-cells was performed with a negative isolation kit, and cells were added to infected tumour cells, 24 hours post infection. T-cell mediated killing was evaluated with XCelligence for a period of 5-6 days (See FIG. 50). Untreated cells (solid black lines), or those incubated with T cells but no virus (black dotted line), showed healthy growth that reached a high level after about 72 h (for both types of cancer cell) and then stabilises. Cells infected with HSV-X-8.1 showed a similar profile (grey solid line) and the virus caused no obvious cell death over the time frame up to 120 h. In contrast, addition of T cells to cells infected with HSV-X-8.1 lead to rapid killing of the cancer cells (grey dotted line), showing that expression of the membrane anchored anti-CD3 ScFv and CD80 encoded by the CD3scFv-2A-CD80 transgene can activated T cell-mediated cytotoxicity to the cancer cells. This is most obvious for HT29 cells infected with a higher concentration (C1) of HSV-X-8.1.8 (FIG. 50), but is also seen in HT29 cells using a lower (C2) virus dose (FIG. 50) and also in SKOV cells treated at the higher virus dose (FIG. 50).

Example 19: Cloning of Vaccinia Virus to Express the CD3scFv-2A-CD80 Transgene

The overall cloning strategy for the vaccinia viruses is shown in Figure V1.

(i) CD3scFv-2A-CD80 Transgene Was Cloned Into the Shuttle Plasmids (×3) By Restriction Digest and Ligation Using the Enzyme Xho.

To insert the transgene into the vaccinia shuttle plasmids (ID: 434-MVA-GFP in which transgene expression is under the control of the p7.5 promoter, ID: 1863-MVA-GFP in which transgene expression is under the control of the mH5 promoter, ID: 1864-MVA-GFP in which transgene expression is under the control of the ssp promoter) the following steps were performed. The three shuttle plasmids were linearised by Xho1 restriction enzyme digest overnight at 37° C., followed by incubation with shrimp alkaline phosphatase (rSAP) for 2 hours at 37° C. for plasmid dephosphorylation to prevent recircularisation of the DNA. To heat inactivate the enzymes, the sample was incubated at 65° C. for 15 minutes. The products were run on a 1% agarose gel to ensure the plasmids were fully linearised as indicated by a single band of 5727 bp for digested 434-MVA-GFP, of 5559 bp for 1863-MVA-GFP and of 5492 bp for 1864-MVA-GFP.

The transgene and polyA sequences were amplified by PCR from the NG-444-R in pUC57-Kan plasmid (SEQ ID NO: 105) and Xho1 restriction sites were added to the ends of the PCR product using the following primers: forward primer=5'-atatatctcgagcccaccatgggatggagc-3' and reverse primer=3'-atatatctcgagcccgggatagctgacgact-5'. The PCR was performed using 100 ng of plasmid DNA and Thermo Scientific Phusion Flash High-Fidelity PCR Master Mix under the following cycling conditions: 1 cycle of 98° C. for 10 s, 30 cycles of 98° C. for 1 s, 64° C. for 5 s, 72° C. for 30 s and 1 cycle of 72° C. for 1 minute. The PCR product was cleaned using Monarch PCR & DNA Cleanup Kit from New England Biolabs and was subsequently digested with Xho1 restriction enzyme for 2 hours at 37° C. To heat inactivate the enzymes, the sample was incubated at 65° C. for 15 minutes. The digested PCR product was run on a 1% agarose gel and a single band of 2182 bp was observed.

Figure 51A:
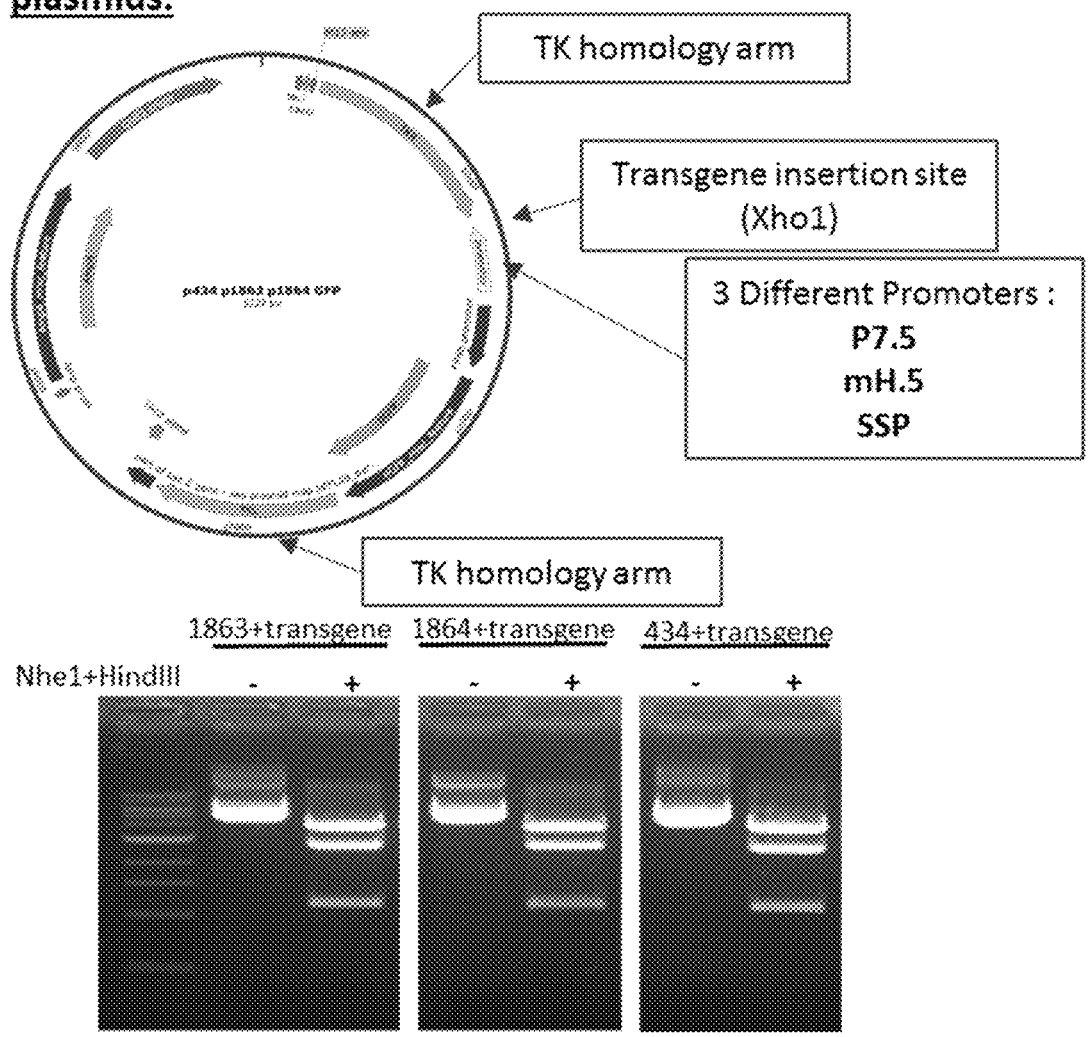
FIG. 51A-B shows the construction of the shuttle plasmid and details of the cloning.
Figure 51B:
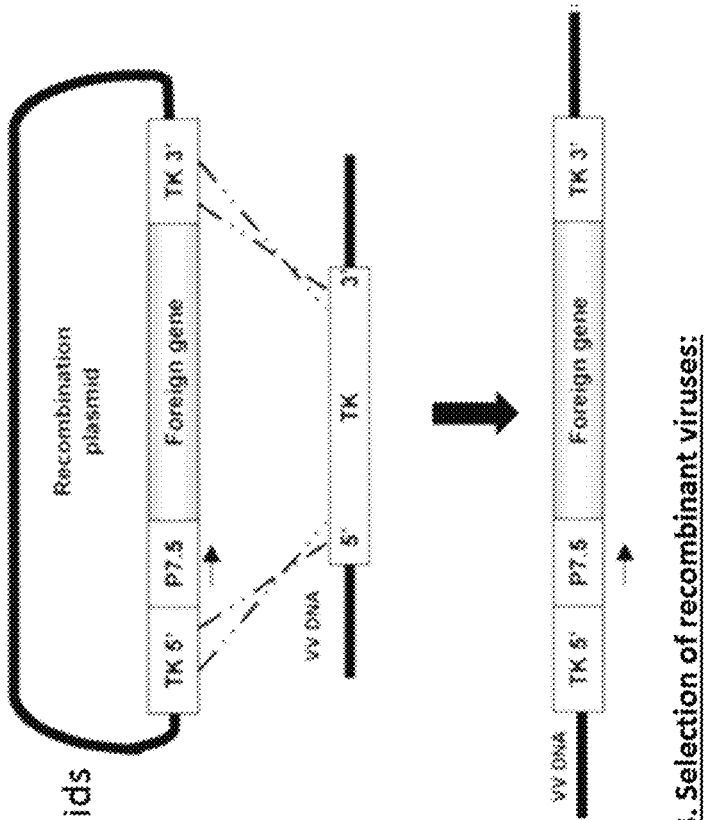
Figure 52A:
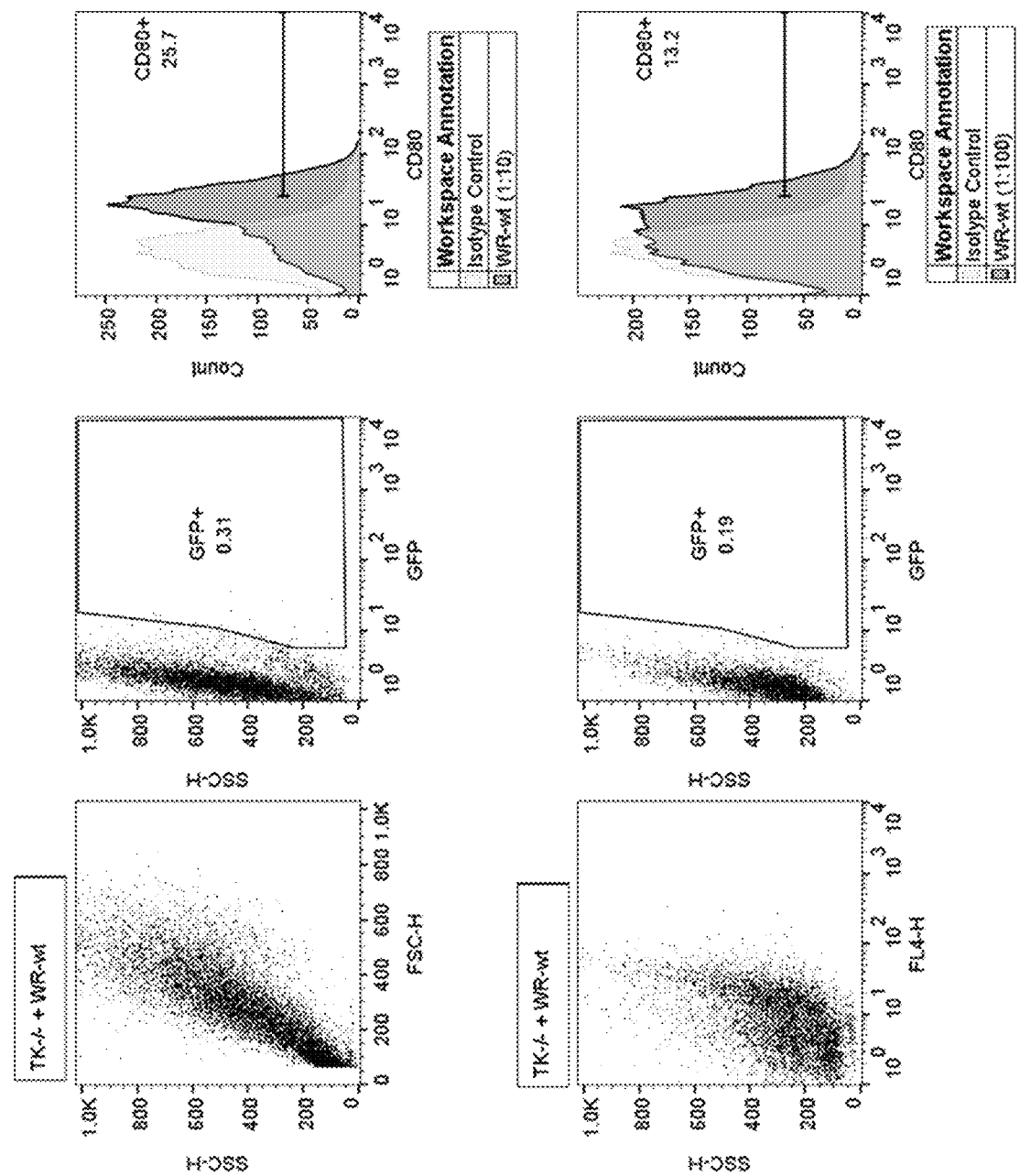
FIG. 52A-B shows CD80 expression by flow cytometry, measuring the geometric mean fluorescence intensity and the percentage of positive cells, for each parameter.
Figure 52A:
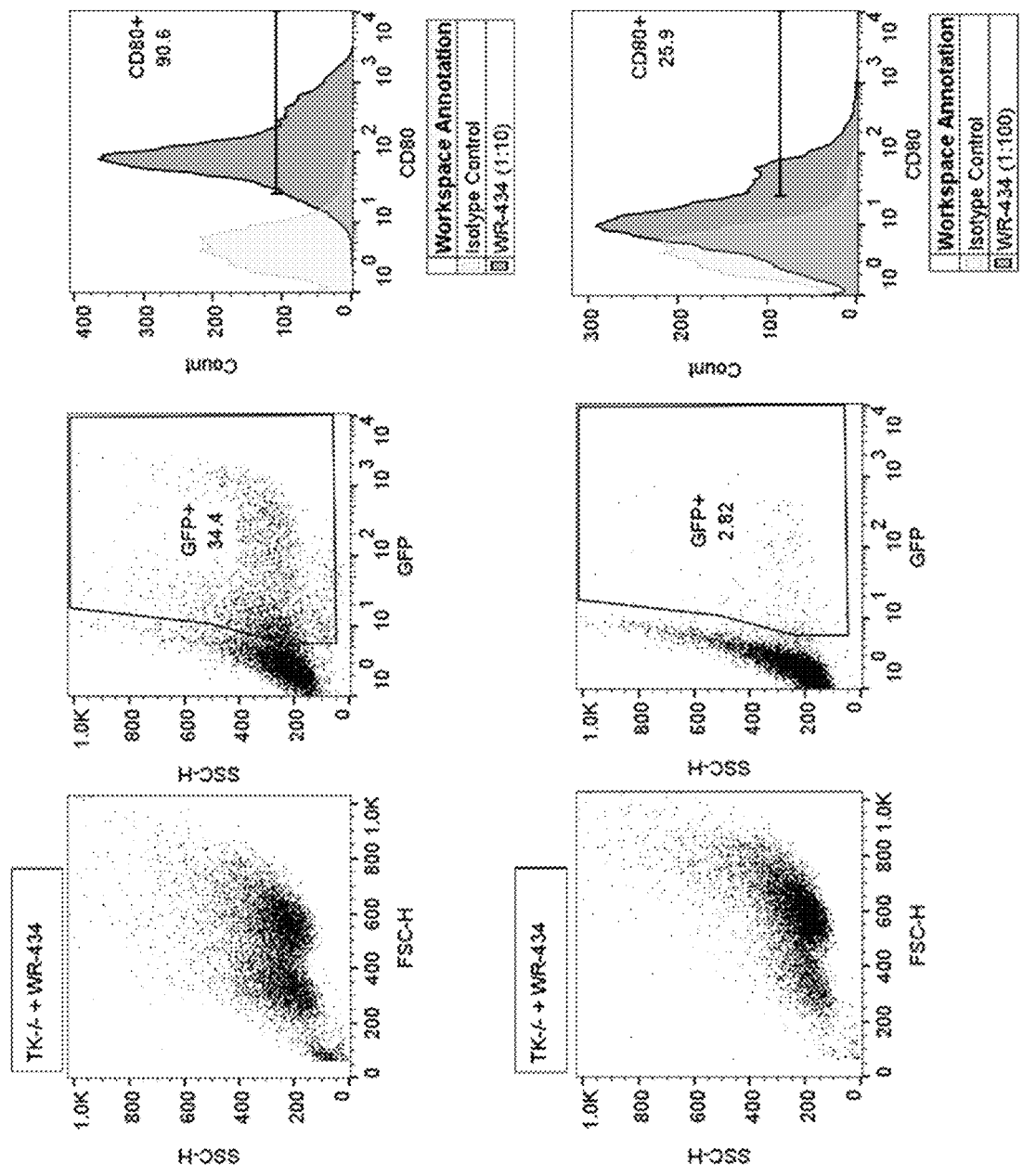
Figure 52B:
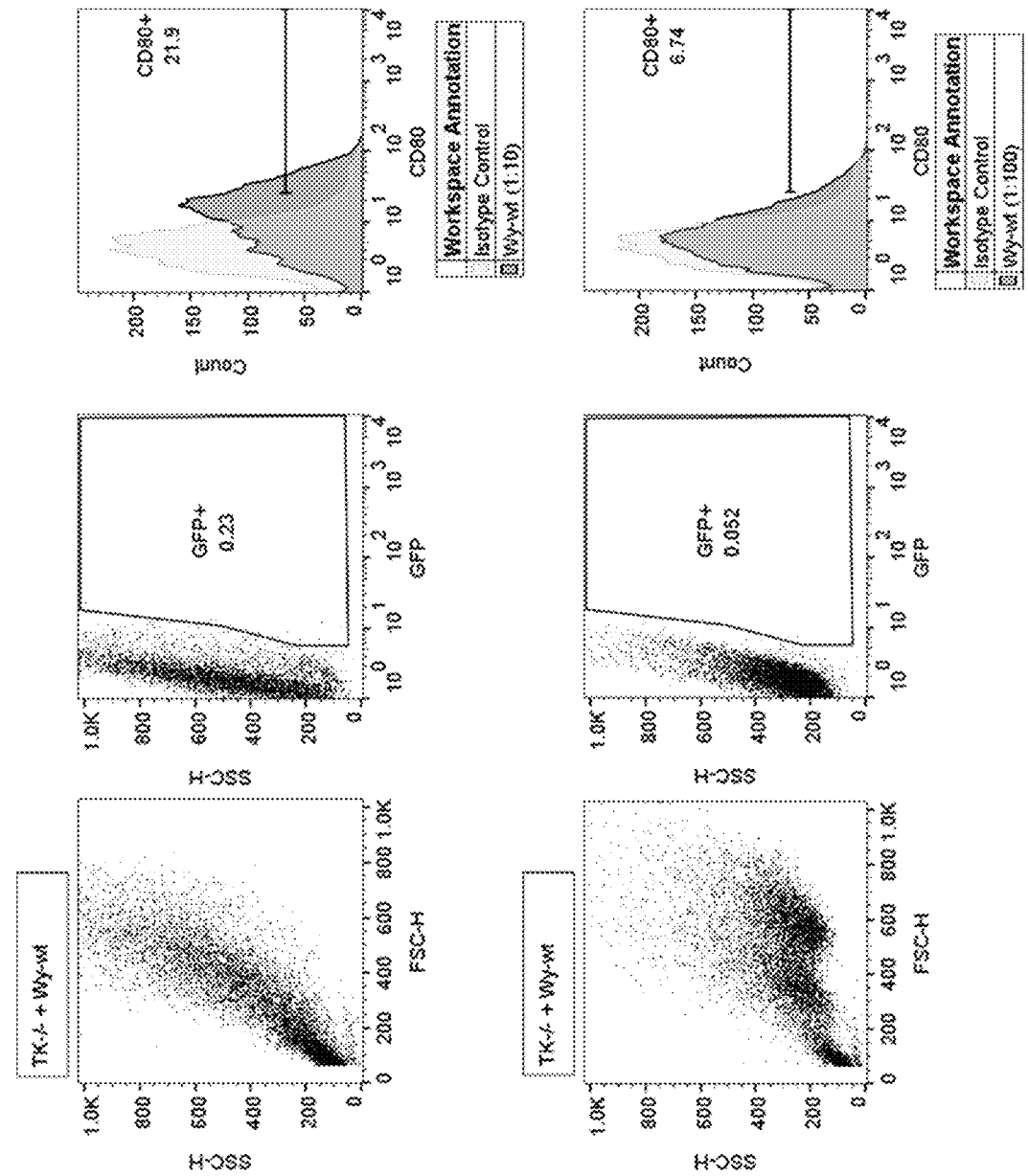
Figure 52B:
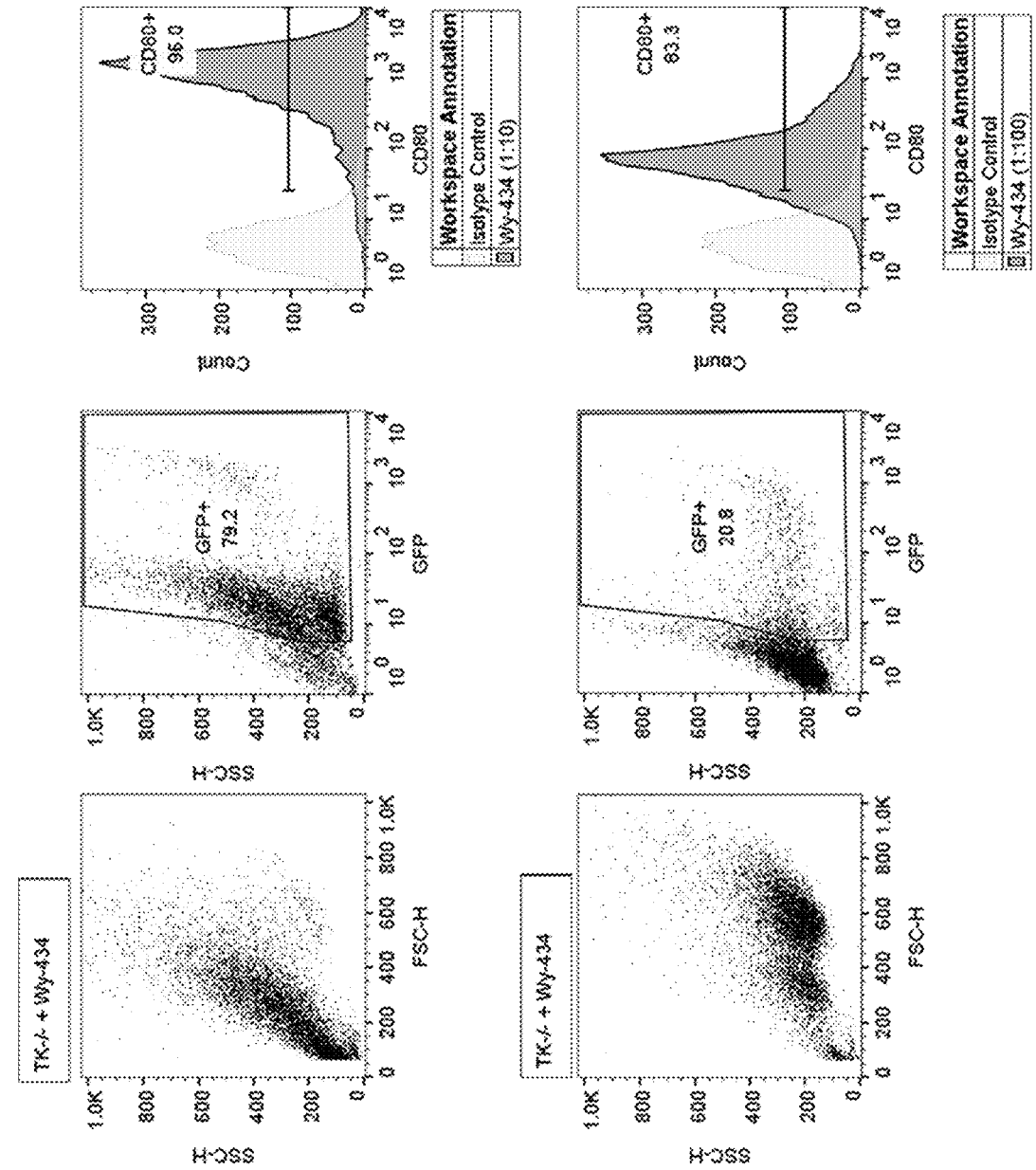

The CD3scFv-2A-CD80 transgene-polyA insert was ligated with the 434-MVA-GFP, 1863-MVA-GFP or 1864-MVA-GFP shuttle vectors (ratio of 3 insert:1 vector) overnight at 16° C. using T4 ligase. The next day 10-beta competent *E. coli* was transformed with 2 μl of the ligation mixture, 100 μl of the transformation spread on LB agar plates with ampicillin and incubated overnight at 37° C. Colonies were picked and screened for the insertion of the transgene-pA in the correct orientation by colony PCR (forward primer=5'-CGTTGAAATGTCCCATCGAG-3' and reverse primer=3'-AGGTACACGATGCACTGGGTAA-5'). The colony PCR products were run on a 1% agarose gel and those with the correct size band of 2182 bp were grown in a maxi prep culture before the plasmid DNA was extracted and purified. The new plasmid constructs (SEQ ID Nos 106, 107 and 108: 434-MVA-GFP+transgene; 1863-MVA-GFP+ transgene; 1864-MVA-GFP+transgene) were verified by restriction digest using Nhe1 and HindIII enzymes (FIGS. 51A-B) and by Sanger sequencing.

(ii) Production of Vaccinia Virus (Western Reserve or Wyeth) Expressing CD3scFv-2A-CD80 Transgene TK−/− cells were seeded in a 6-well plate 24 hours before infection, at a density of $0.6\times10^6$ per well. For infection, serial dilutions (10, 7.5, 5, 2.5, 1, 0.5, 0.25, 0.1, 0.05 and 0.01 µl) of Western Reserve or Wyeth virus were used. Fresh media (DMEM 5% FBS) together with the corresponding virus amount was added to the cells and incubated for 2 h. After 2 h of vaccinia infection, the cells were transfected with the vaccinia shuttle plasmids (434-MVA-GFP+transgene, 1863-MVA-GFP+transgene or 1864-MVA-GFP+transgene) containing the CD3scFv-2A-CD80 transgene for homologous recombination. Each plasmid (2.5 µg) was diluted in 250 µl of Opti-MEM media, subsequently mixed with Lipofectamine transfection reagent (also diluted in Opti-MEM) and incubated for 20 min. The transfection complexes were then added dropwise to the cells and incubated for 4-6 hours, when fresh 5% FBS DMEM was added to the cells. Cells were harvested after 48-72 hours, and pelleted at 20000×g for 20 min at 4° C. The supernatant was discarded, and the cells were resuspended in warm PBS and subjected to 3 freeze-thaw cycles. Subsequently, cell debris was removed by centrifugation at 500 g for 2 minutes and the supernatant containing the virus was transferred to a new tube and stored at −80° C.

(iii) Amplification of Vaccinia Viruses (Western Reserve or Wyeth) Expressing CD3scFv-2A-CD80 Transgene For the amplification of TK-negative recombinant viruses expressing CD3scFv-2A-CD80 transgene, the harvested virus was passaged in TK−/− cells in the presence of BrdU (25 µg/ml or 81.4 µM). In brief, TK−/− cells were seeded in a 6-well plate 24 h before infection at a density of 0.6×106 per well. Fresh media (DMEM 5% FBS) containing BrdU (25 mg/ml or 81.4 µM) together with the corresponding virus was added to the cells and incubated for 48-72 h. This process was repeated three times.

Example 20: Transgene Expression and T Cell Activation by Vaccina Virus Expressing CD3scFv-2A-CD80

(i) Evaluation of Transgene Expression in TK−/− Cells

To evaluate if the recombinant Vaccinia Virus could express transgene CD3scFv-2A-CD80, TK−/− cells were seeded in 24-well plates, 24 hours prior to infection with VV-Wyeth-434-CD3scFv-2A-CD80 (Wy-434), VV-Western Reserve-434-CD3scFv-2A-CD80 (WR-434) (100 µl of 1:10 or 1:100 dilution from crude virus preparation, titre unknown). As control, the wild type viruses VV-Wyeth wild type (Wy-wt) and VV-Western Reserve-wild type (WR-wt) were also included. Cells were harvested 24 hours after infection, and stained with anti-human CD80-APC conjugated antibody, to evaluate CD80 expression by flow cytometry, measuring the geometric mean fluorescence intensity and the percentage of positive cells, for each parameter (see FIG. 52A for Western Reserve and FIG. 52B for Wyeth Strains). Additionally, expression of the GFP reporter gene was also evaluated by flow cytometry at two different concentrations (1:10 and 1:100) and GFP was expressed only by the recombinant viruses WR-434 and Wy-434 (FIGS. 52 C&D). Both recombinant viruses were also able to express CD80, unlike the wild type control viruses (FIGS. 52 E&F).

Figure 53A:
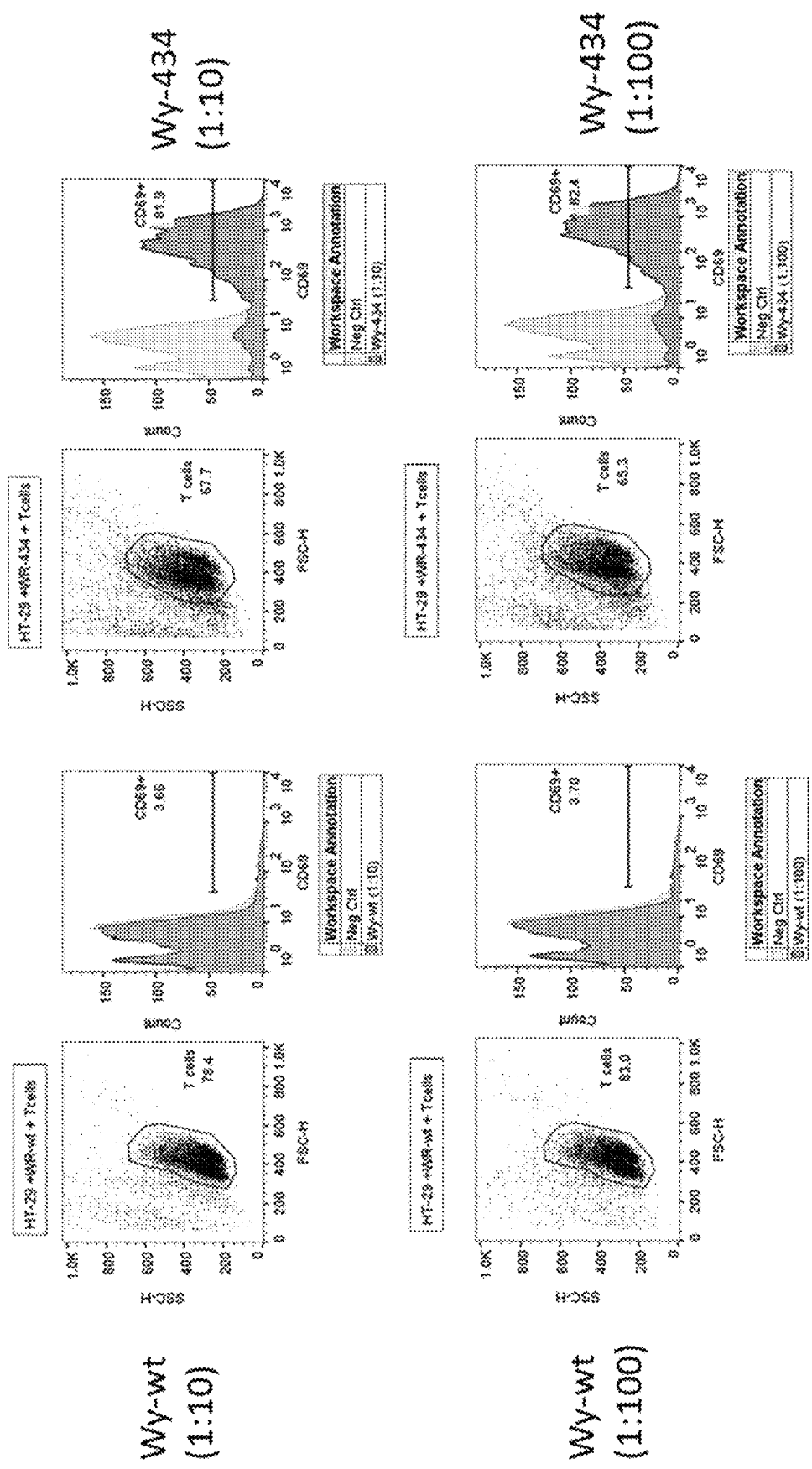
FIG. 53A-B shows T cell activation was evaluated by flow cytometry of CD69 expression for HT29 cells and SKOV cells.
Figure 53B:
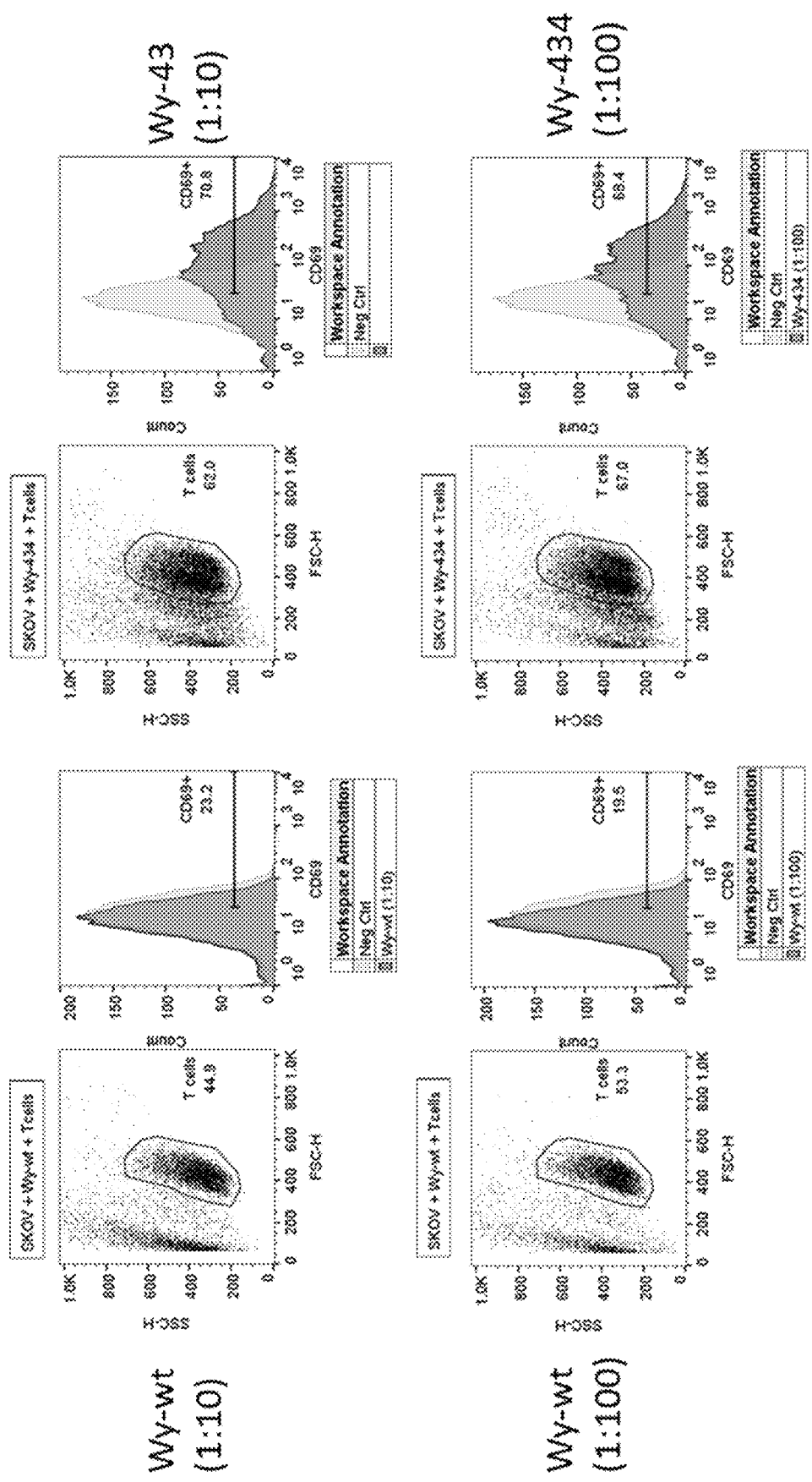
Figure 53K:
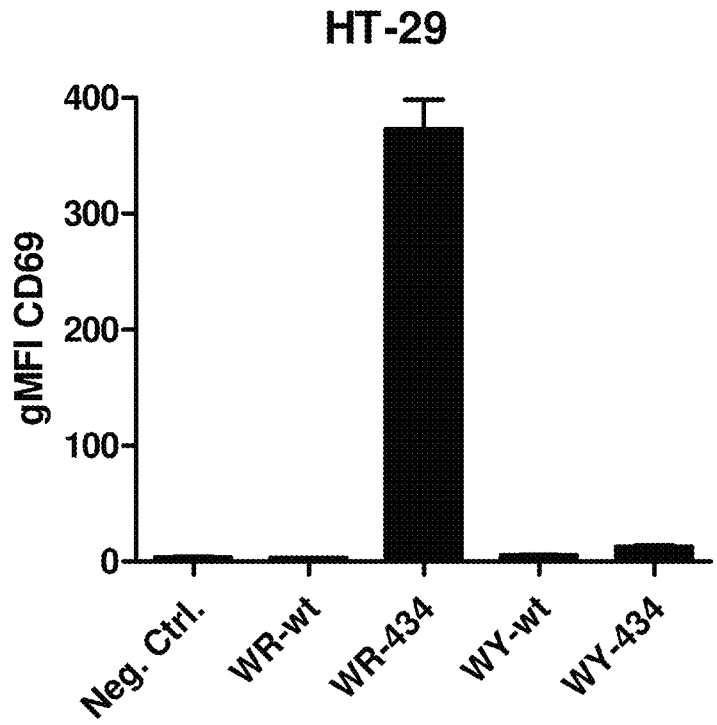
Figure 53L:
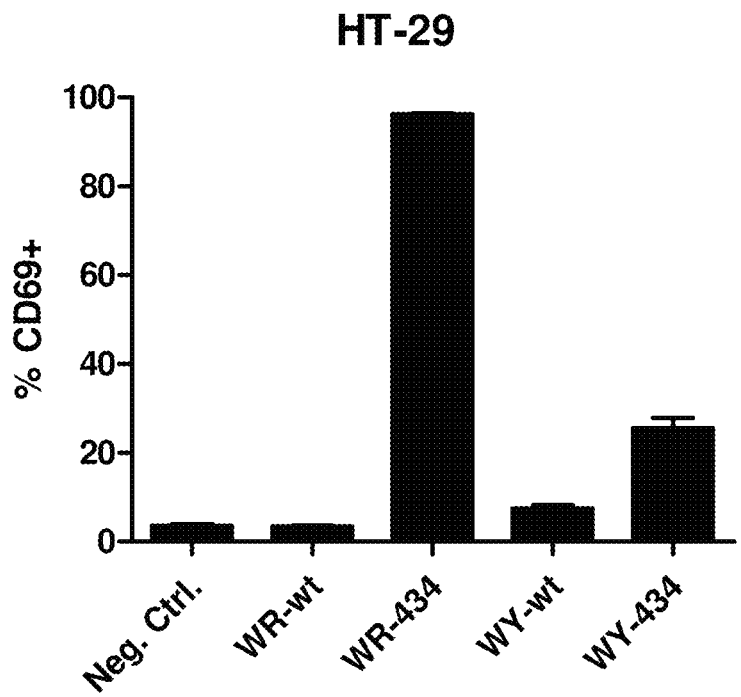

(ii) Activation of T Cells Exposed to HT-29 and SKOV Tumour Cells That Were Pre-infected With the Recombinant Viruses HT-29 and SKOV cells were seeded in 96 well plates (10,000 cells/well) 24 hours before infection with dilutions of Wy-434, Wy-wt, WR-434 and WR-wt ($10^{-1}$ and $10^{-2}$ dilutions from crude virus preparations). Cryopreserved peripheral blood lymphocytes were thawed and left to rest over night at 37° C. Selection of T cells was performed with a negative isolation kit, and cells (50,000/well) were added to VV-CD3scFv-2A-CD80-infected HT-29 or SKOV cells. Non-adherent T cells and cellular supernatant samples were harvested 24 hours later. Supernatant samples were assessed for IFNγ secretion (see example 8 and Figure D4). The T cells were stained with anti-human CD69-APC conjugated antibody. T cell activation was evaluated by flow cytometry for CD69 expression (see FIG. 53A for HT29 cells and FIG. 53B for SKOV cells). Both CD3scFv-2A-CD80 transgene-bearing vaccinia viruses led to activation of T-cells as assessed by CD69 upregulation. Evidence of the functional CD80 and/or antiCD3 scFv transgene expression is shown by the ability to activate T cells upon infection of HT-29 and SKOV cells by WR-434 and Wy-434, but not by the wild type viruses. The data are expressed as % positive cells and also as the gMFI (the geometric mean fluorescence of the positive population) and summarised in FIG. 53C-J). In an additional experiment, HT-29 cells were seeded in a 96-well plate (40.000 cells/well) 24 hours prior to infection with Wy-434, Wy-wt, WR-434 and WR-wt ($10^{-1}$ and $10^{-2}$ dilutions from crude virus preparations). T cells were added as described previously, and harvested 24 hours later. Expression of CD69 was measured by flow cytometry (FIGS. 53K-L), and IFNγ production was measured by ELISA (FIG. 58D).

Figure 54A:
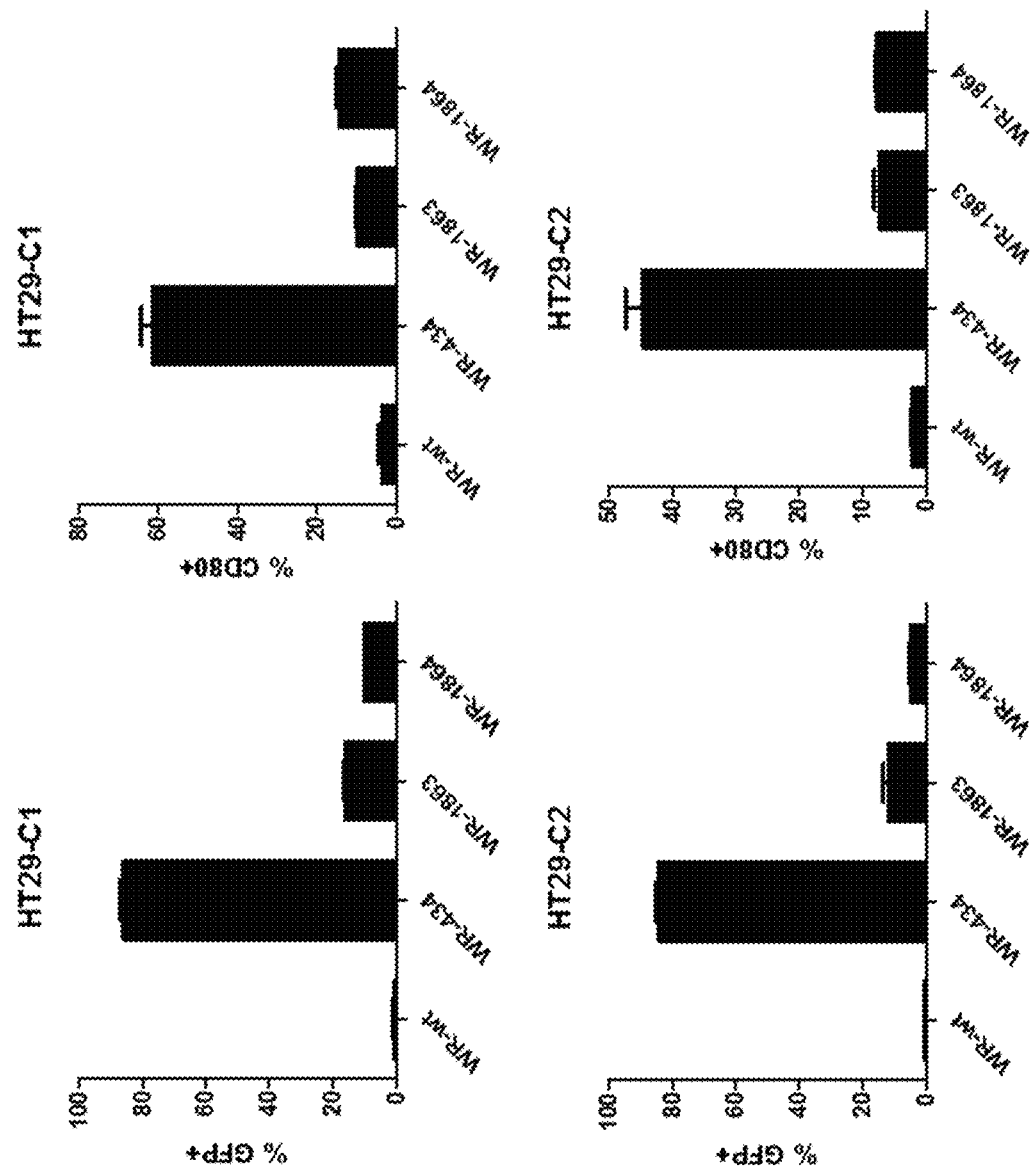
FIG. 54A-D shows expression of CD80 and GFP measured in infected tumour cells, and CD69 measured on lymphocytes.
Figure 54A:
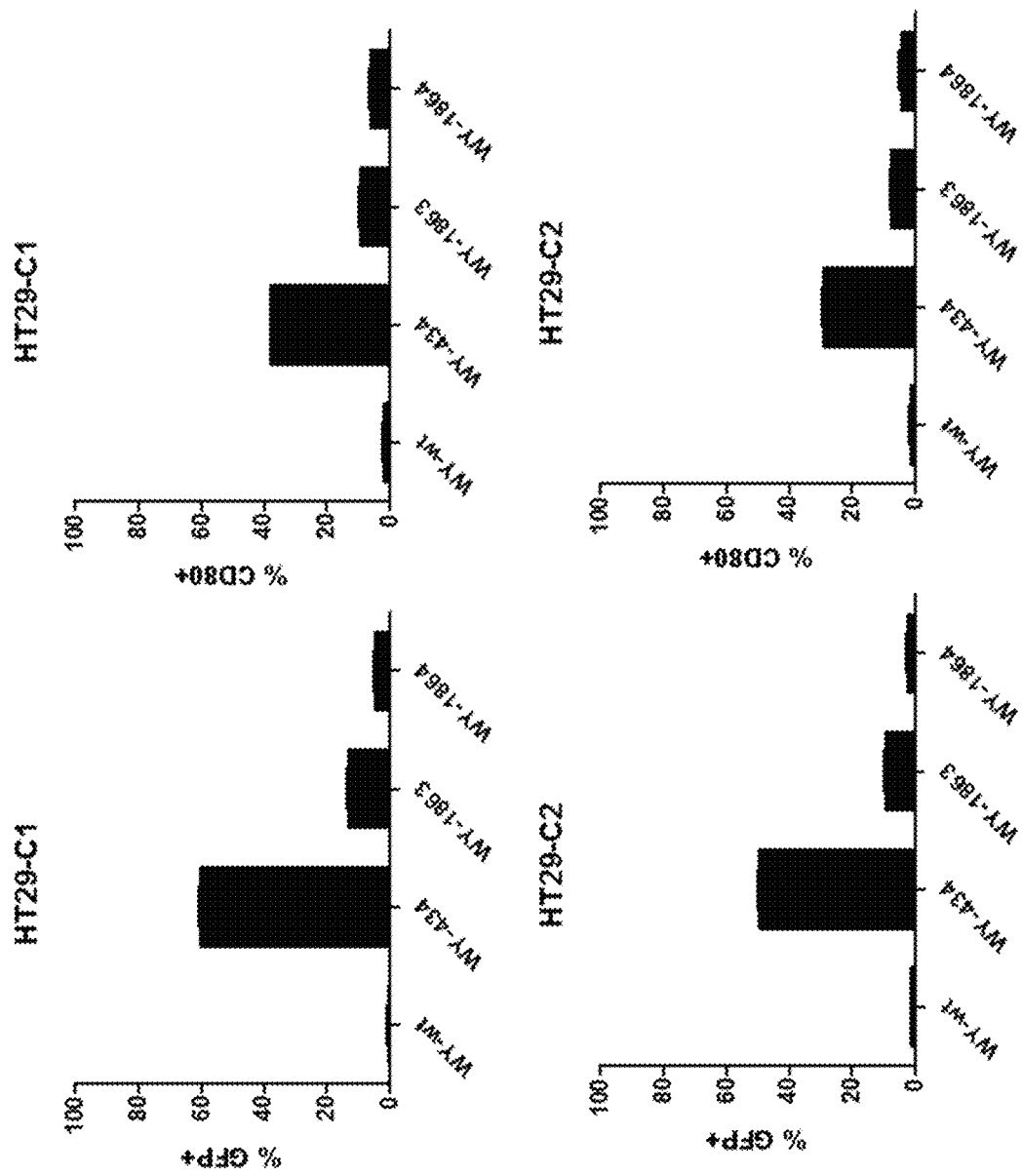
Figure 54B:
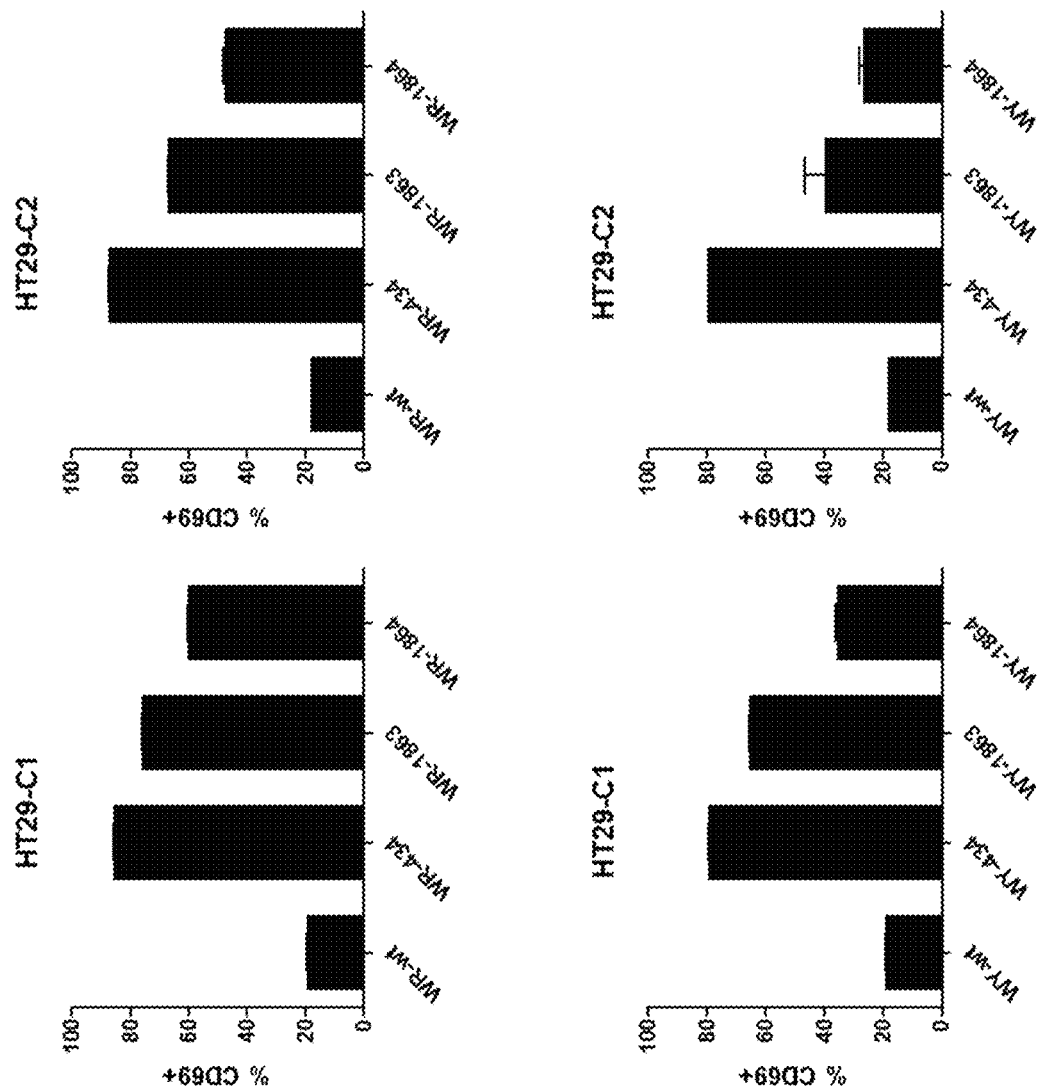
Figure 54C:
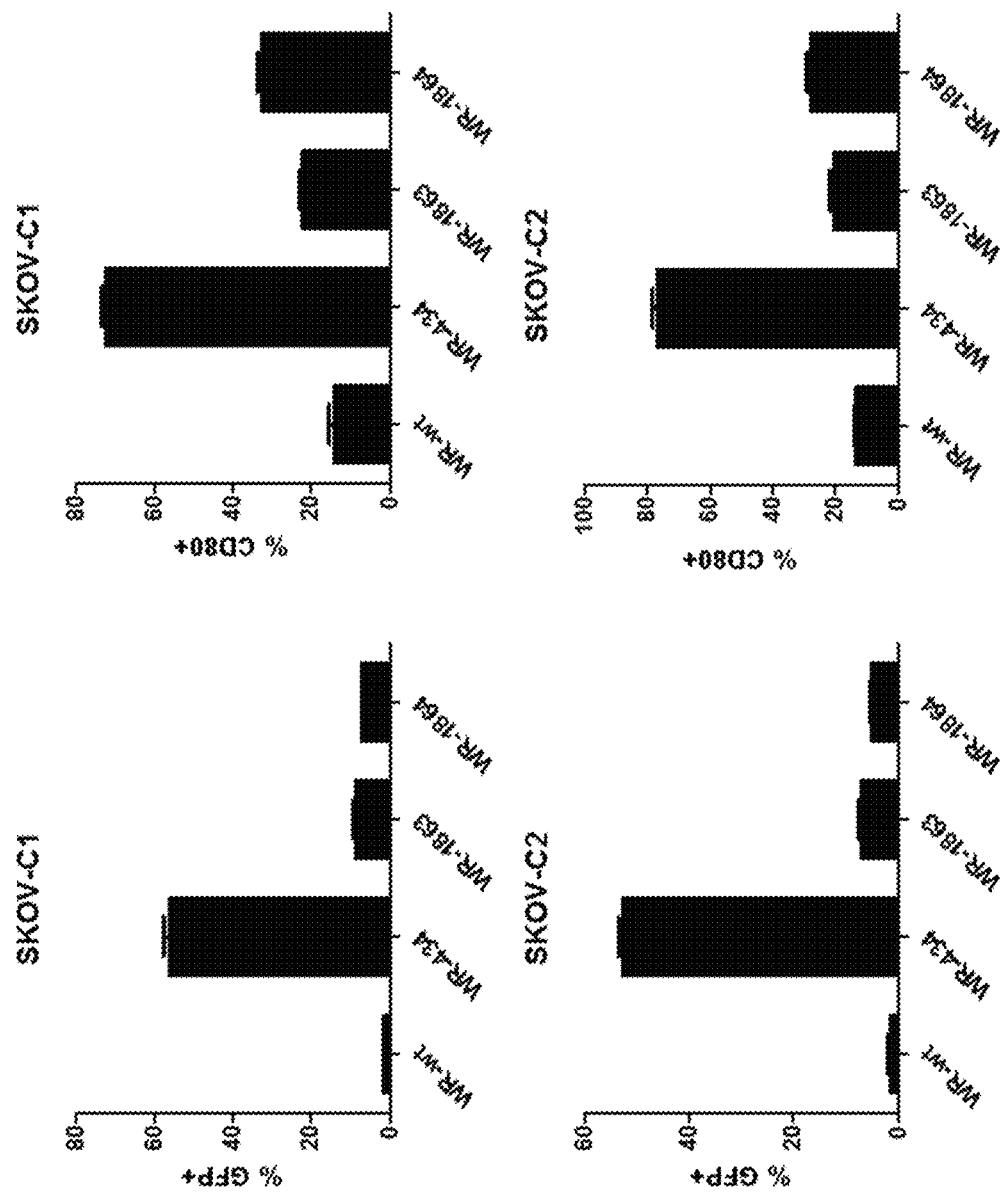
Figure 54C:
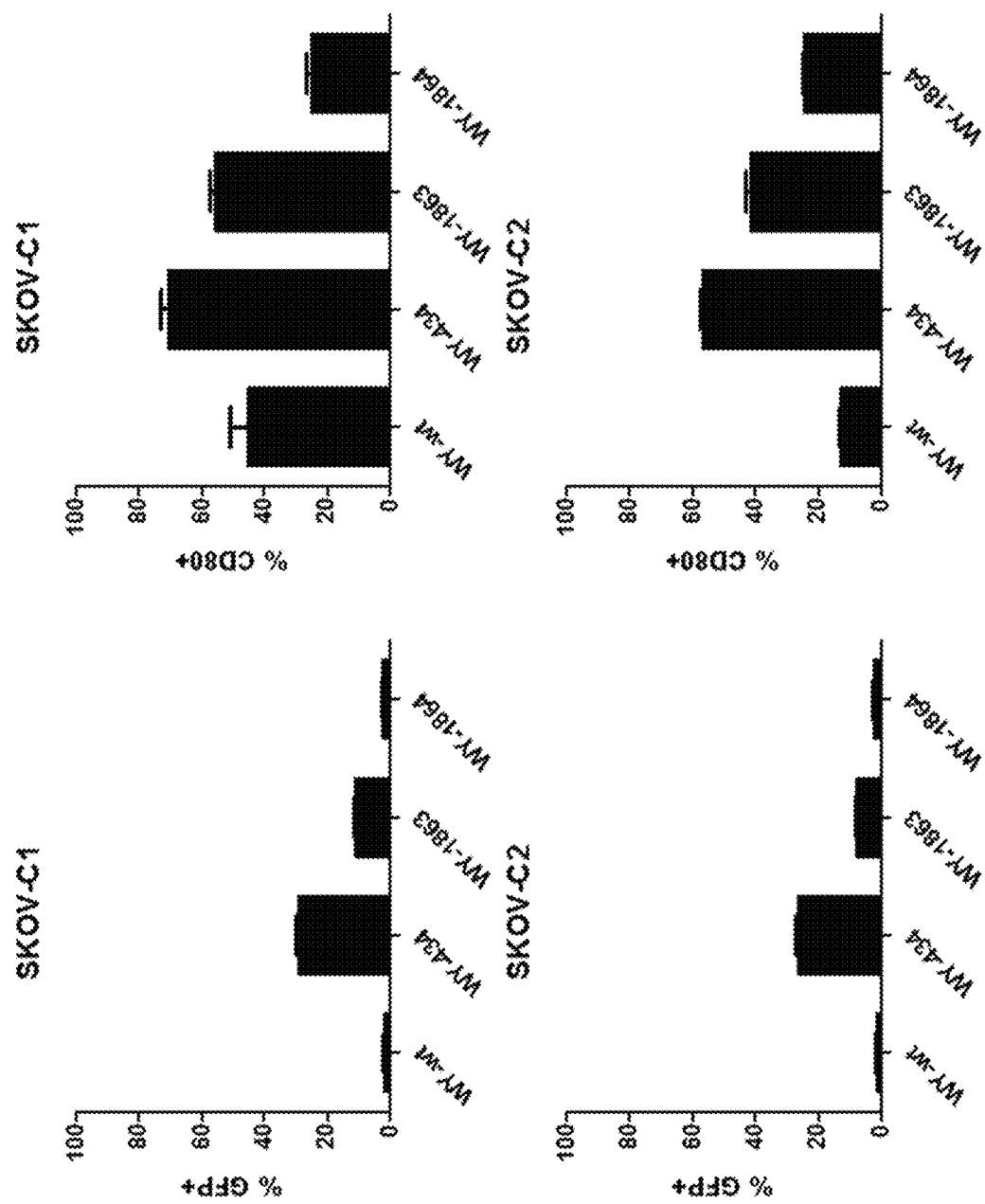
Figure 54D:
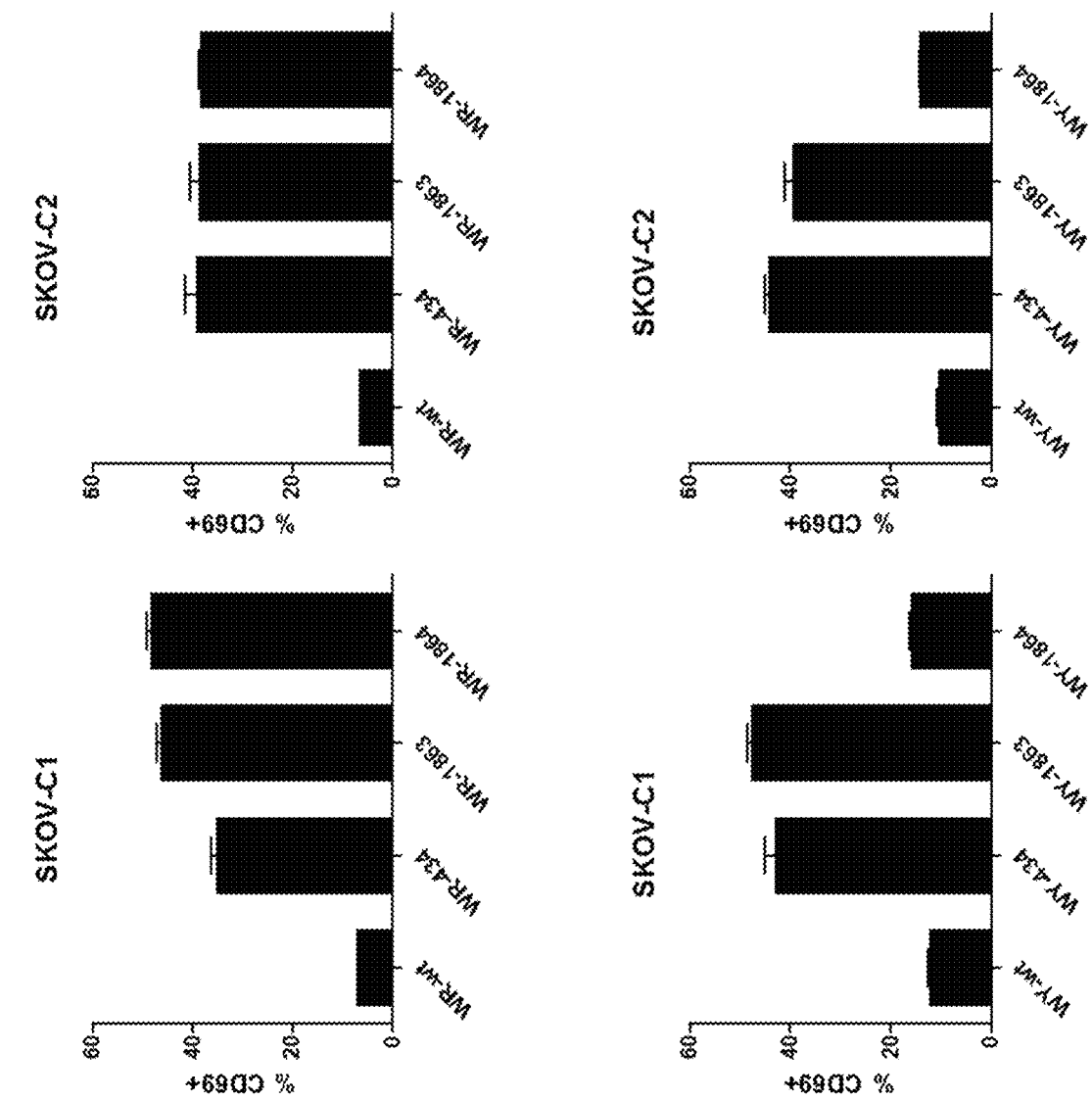

Recombinant viruses expressing CD3scFv-2A-CD80 under different promoters (434, 1863 or 1864, referring to the p7.5, mH5 and ssp promoters, respectively) were also used to infect HT29 or SKOV tumour cells. Cells were seeded in 24-well plates, 24 hours prior to infection with different doses of WR-wt, WR-434, WY-wt and WY-434 (C1=10 µl from crude virus preparations, C2=2 µl from crude virus preparations) or WR-1863, WR1864, WY-1863 and WY-1864 (C1=100 µl from crude virus preparations, C2=20 µl from crude virus preparations). Expression of CD80 and GFP was measured in infected tumour cells, and CD69 was measured in lymphocytes, as described previously. The results show that all recombinant viruses are able to express CD80 upon infection of HT29 (FIG. 54A) or SKOV cells (FIG. 54C) and induce activation of T cells (FIG. 54B, D).

Figure 55A:
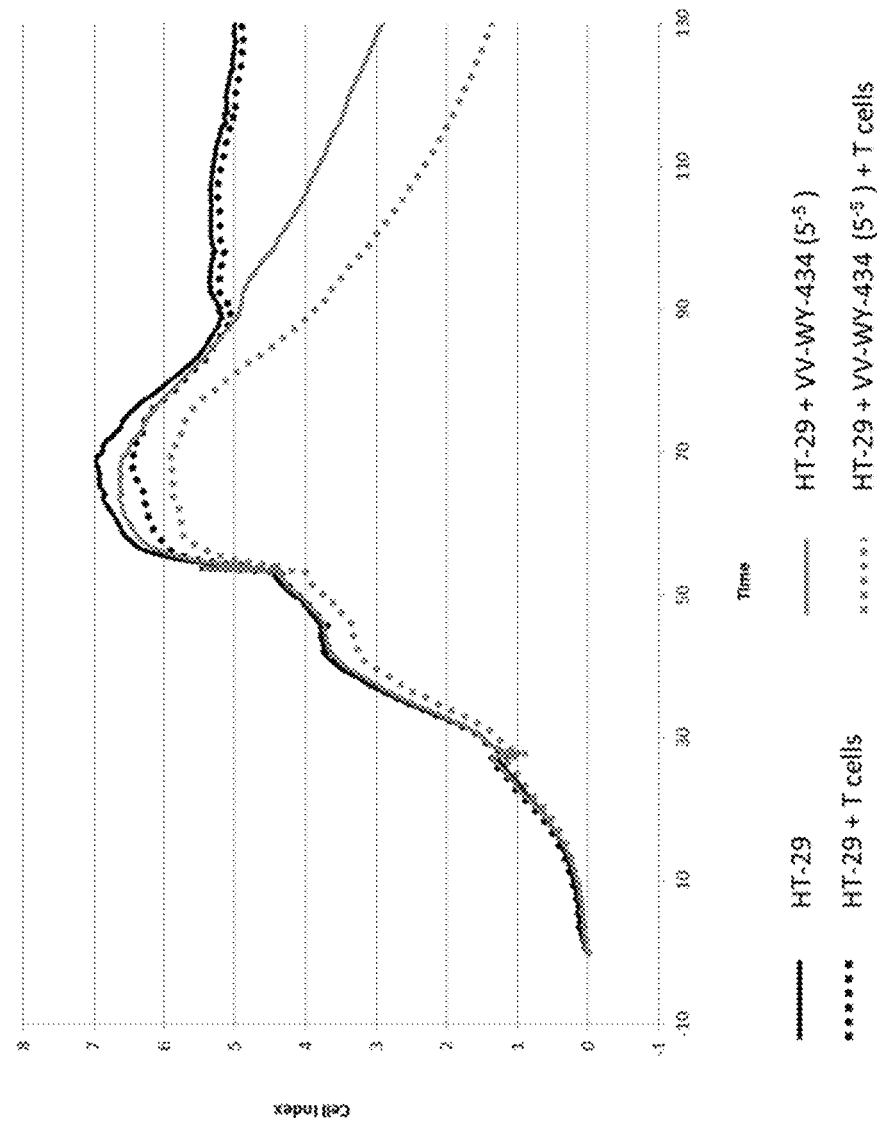
FIG. 55A-C show T-cell mediated killing evaluated with XCelligence for a period of 5-6 days. Untreated cells (solid black lines), or those incubated with T-cells but no virus (black dotted line), show healthy growth that reaches a high level after about 72 h (for both types of cancer cell) and then stabilises.
Figure 55B:
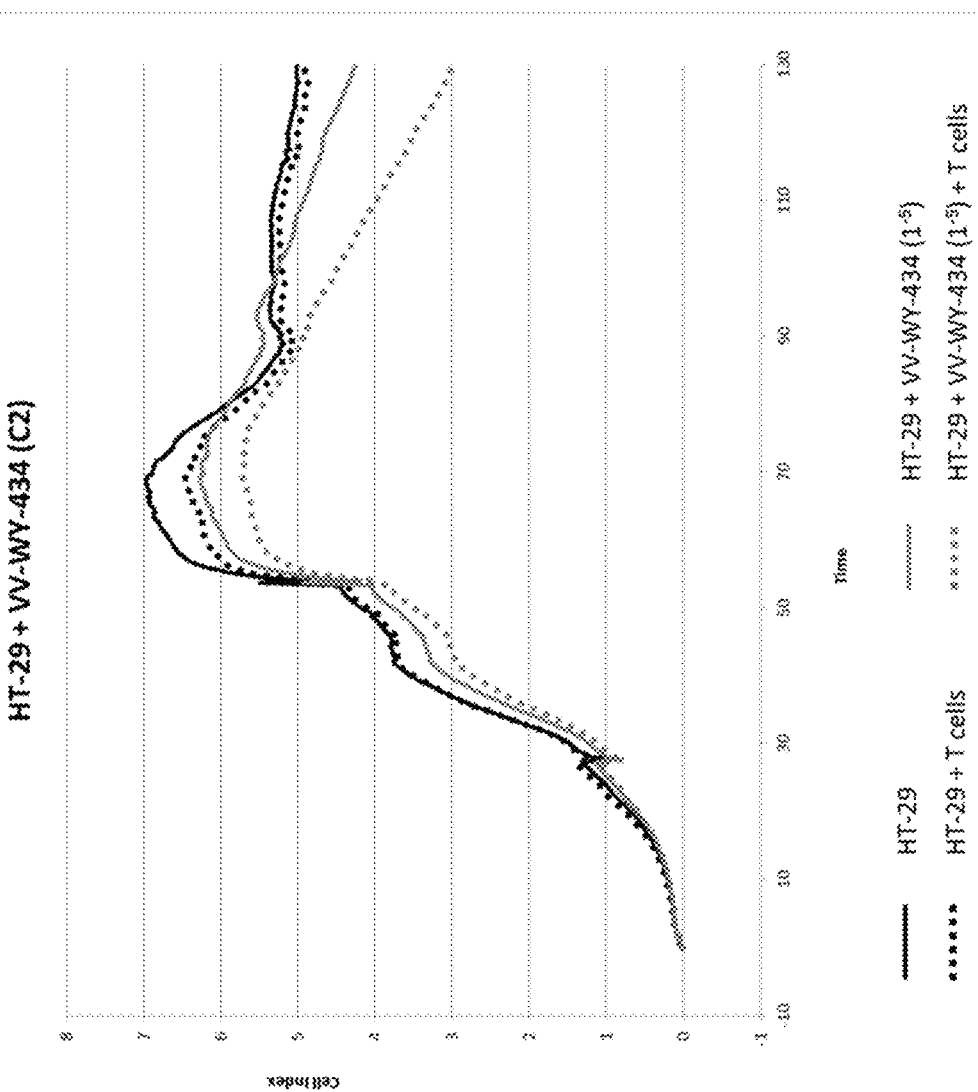
Figure 55C:
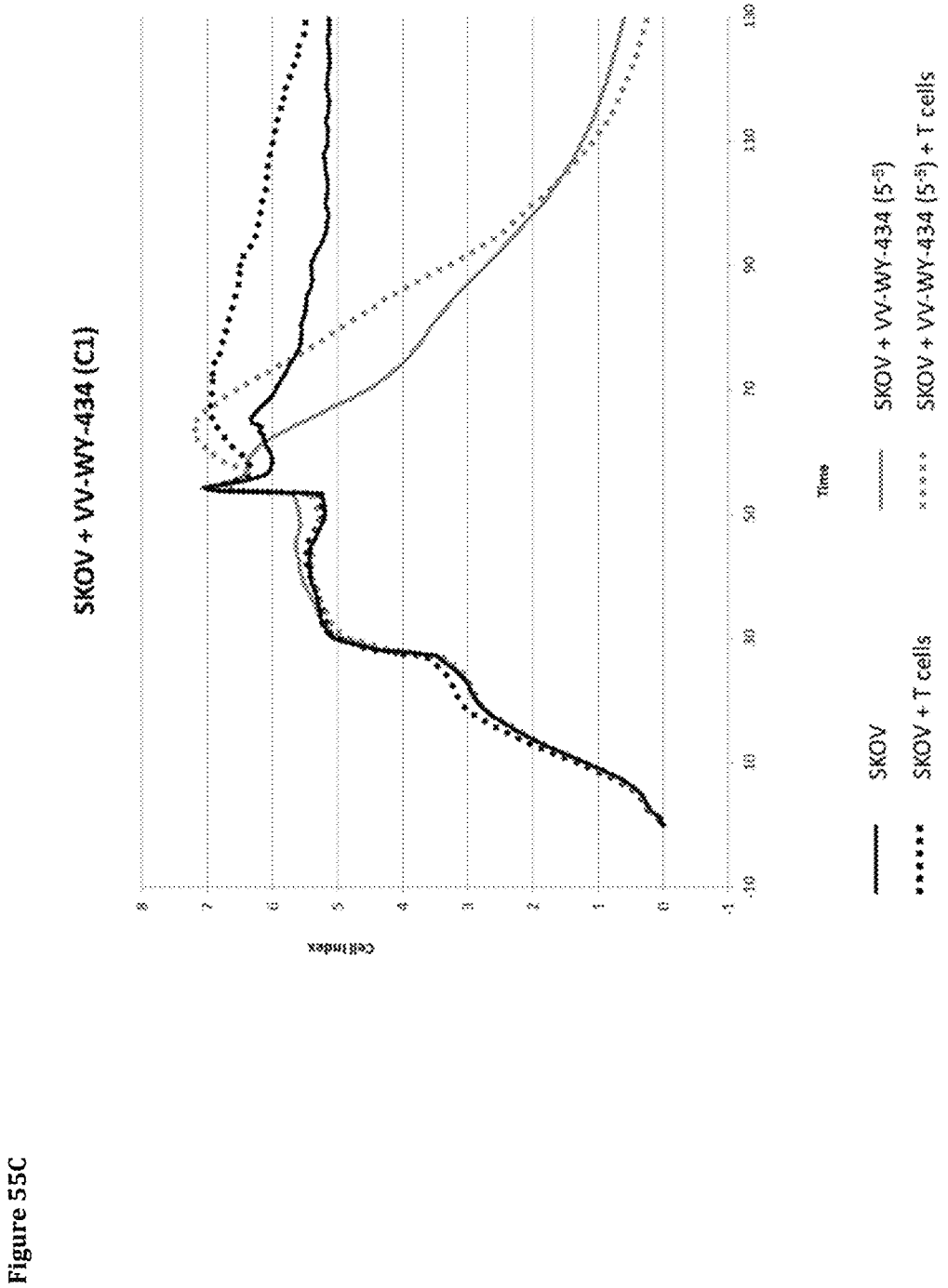

(iii) Infection of HT-29 and Evaluation of Direct Virus-mediated Killing By XCelligence HT-29 and SKOV cells were seeded on 16 well-plates (20,000 cells/well), 24 hours before infection with VV-WY-434-X (Concentration 1 [C1]=$5^{-5}$ from crude virus preparation, titre unknown; Concentration 2 [C2]=$1^{-5}$ from crude virus preparation, titre unknown). Cryopreserved Peripheral blood lymphocytes were thawed and left to rest over night at 37° C. Selection of T-cells was performed with a negative isolation kit, and cells were added to infected cells, 24 hours post infection. T-cell mediated killing was evaluated with XCelligence for a period of 5-6 days (See FIG. 55). Untreated cells (solid black lines), or those incubated with T-cells but no virus (black dotted line), show healthy growth that reaches a high level after about 72 h (for both types of cancer cell) and then stabilises. Cells infected with VV-WY-434-X show a similar profile (grey solid line) up to 72 h, although the virus then shows direct cytotoxicity and progressive cell kill. Addition of T-cells to tumour cells infected with VV-WY-434-X leads to accelerated killing of the cancer cells (grey dotted line), showing that expression of the membrane anchored anti-CD3 ScFv and CD80 encoded by the CD3scFv-2A-CD80 transgene can activated T cell-mediated cytotoxicity to the cancer cells. This is most obvious for HT29 cells infected with a higher concentration (C1) of VV-WY-434-X (FIG. 55A), but is also seen in HT29 cells using a lower (C2) virus dose (FIG. 55B). In SKOV cells treated at the higher virus dose the virus alone shows appreciable cytotoxicity, and the presence of T cells appears to slightly delay cytotoxicity but then potentiates it so that SKOV cells are rapidly killed (FIG. 55C).

Example 21: Production of Replication Competent Adenovirus Type 5 Virus Expressing the T Cell Activating Antigen CD80 and a Membrane-anchored Single Chain Fv Fragment Antibody to the ε Chain of the Human CD3 Complex (CD3ε)

The plasmid pAd5-348 was generated by two-step assembly. First, a DNA cassette encoding the human T cell activating antigen CD80 (SEQ ID NO 126) and a membrane-anchored chimeric form of the single chain Fv anti-human CD3ε (SEQ ID NO: 127) was assembled into an Ad5 shuttle vector to produce an Ad5-348 precursor vector. Secondly a DNA fragment containing the Ad5 E2B polymerase was inserted back into the Ad5-348 precursor vector to generate the pAd5-348 plasmid. The pAd5-348 plasmid therefore contains the Ad5 genome with the transgene cassette inserted in the deleted E3 region. The transgene cassette contains: a 5'CMV promoter (SEQ ID NO. 109); membrane-anchored anti-human CD3ε ScFv cDNA; a high efficiency self-cleavable P2A peptide sequence (SEQ ID NO: 94); human CD80 cDNA sequence and a 3' polyadenylation sequence (SEQ ID NO: 99). Construction of the plasmid was confirmed by DNA sequencing.

Virus Production and Characterisation

The plasmid pAd5-348 was linearised by restriction digest with the enzyme PacI to produce the virus genome Ad5-348 (SEQ ID NO: 110). The Ad5-348 genome (10 μg) was transfected into Ad293 cells and then monitored every monitored every 24 hrs and supplemented with additional media every 48-72 hrs. The production of virus was monitored by observation of a significant cytopathic effect (CPE) in the cell monolayer. Once extensive CPE was observed the Ad5-348 virus was harvested from AD293 cells by four freeze-thaw cycles to produce a viral lysate stock.

Figure 56A:
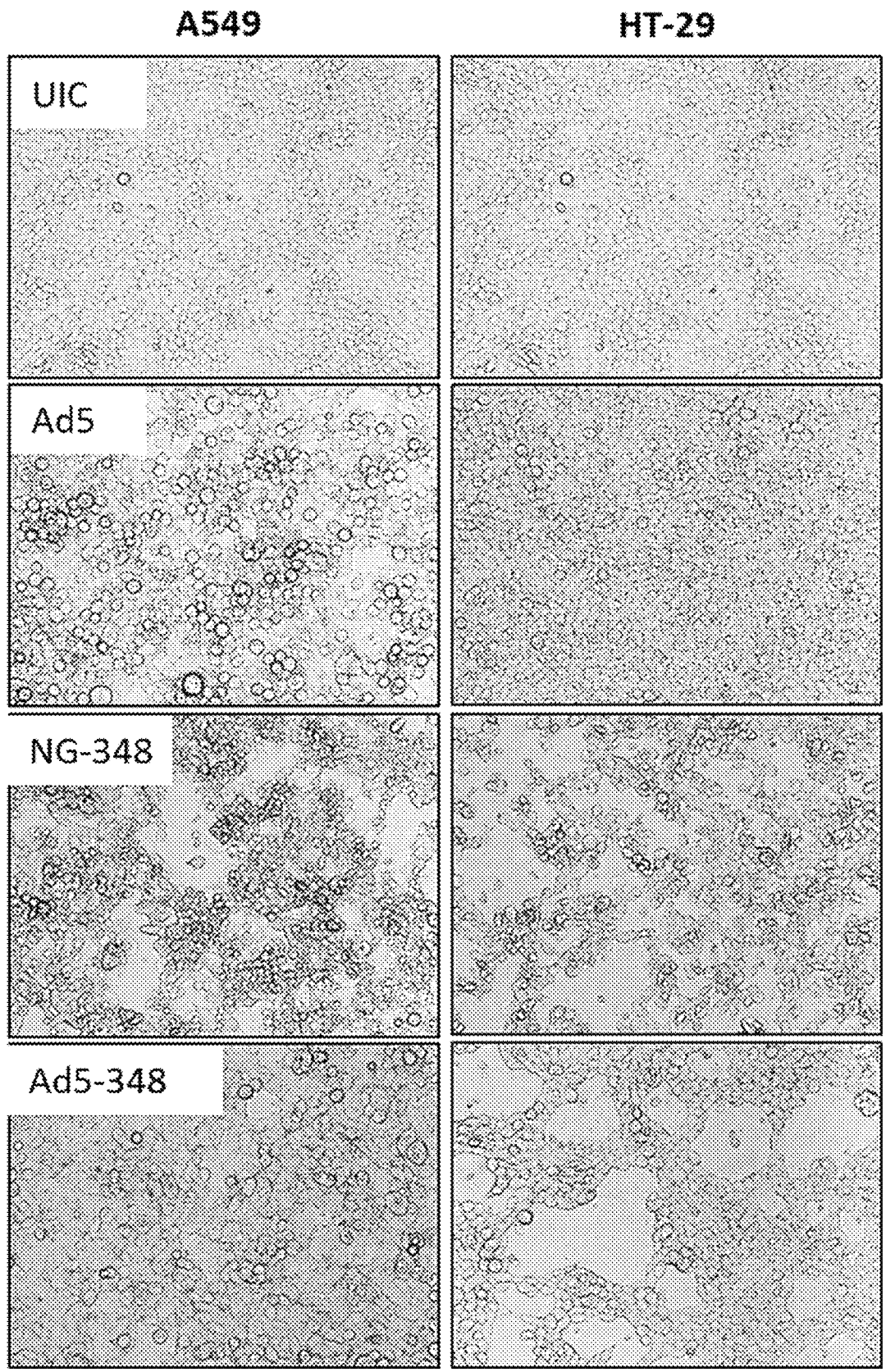
FIG. 56A shows cell viability assessed by observation of CPE in the cell monolayers. NG-348, Ad5-348 and Ad5 all showed significant CPE by 48 hrs post-infection with 100 ppc (NG-348 or Ad5) or 1 in 10 and 1 in 50 dilution of virus stock (Ad5-348).

Example 22: Oncolytic Activity and Replication of the Ad5-348Rep Virus in Colon and Lung Carcinoma Cells Virus Oncolytic Activity HT-29 colon carcinoma cells or A549 lung carcinoma were seeded in 24 well plates at a cell density of 8e5 cells/well and 5e5 cells/well respectively. Plates were incubated for 4 hrs, 37° C., 5% $CO_2$, before cells were either infected with Ad5 or NG-348 (100 ppc) or Ad5-348 virus particles (1 in 50 or 1 in 10 dilution). Cell viability was assessed by observation of CPE in the cell monolayers. NG-348, Ad5-348 and Ad5 all showed significant CPE by 48 hrs post-infection with 100 ppc (NG-348 or Ad5) or 1 in 10 and 1 in 50 dilution of virus stock (Ad5-348) (FIG. 56A).

Virus Replication Assessed By qPCR

Figure 56B:
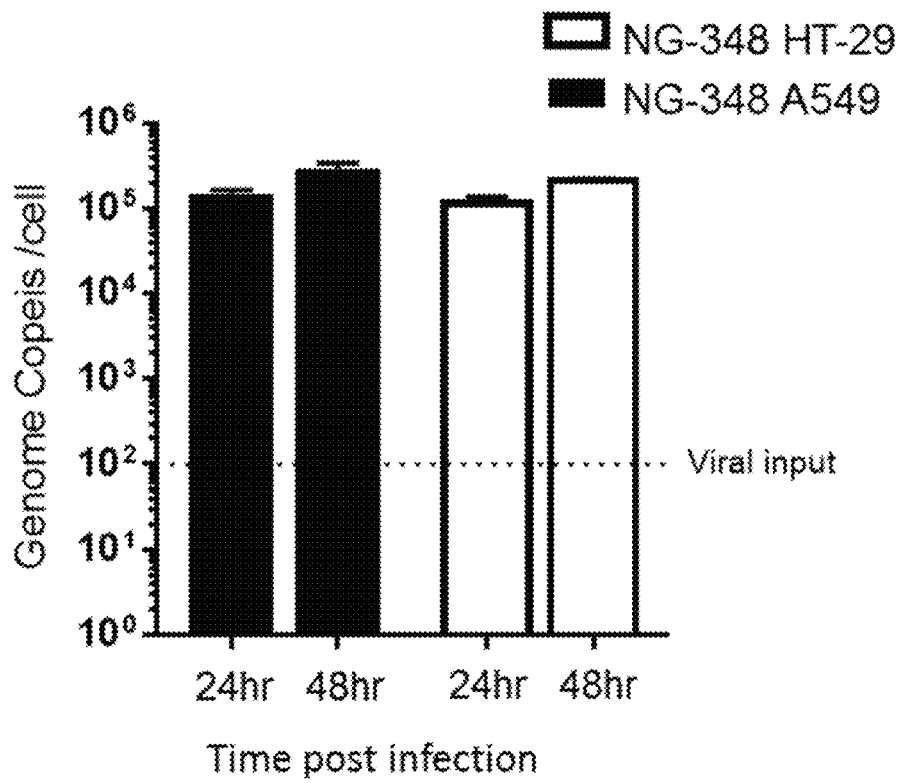
FIG. 56B-C shows quantification of the number of detected virus genomes per cell for two cells lines HT-29 and A549. The data indicates that NG-348 and Ad5-348 replicated in both cell lines
Figure 56C:
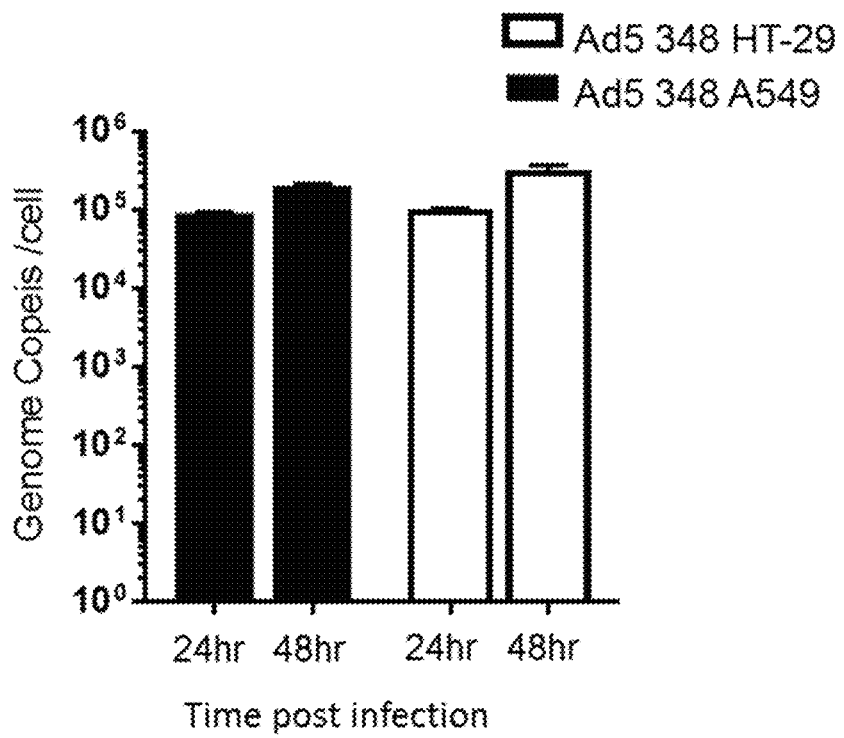

HT-29 or A549 cells were either infected with 100 ppc NG-348 or Ad5 or a 1 in 10 or 1 in 50 dilution of Ad5-348 viral lysates or were left uninfected. After 24 or 48 virus supernatants were harvested and used for quantification of viral DNA by qPCR. Cell supernatants were collected and clarified by centrifuging for 5 mins, 1200 rpm. DNA was extracted from 0.1 μL of lysate using the Qiagen Blood and Tissue DNA extraction kit, according to the manufacturer's protocol. A standard curve using NG-348 virus particles (2.5e10-2.5e5vp) was also prepared and extracted using the Qiagen Blood and Tissue Kit. Each extracted sample or standard was analysed by qPCR using a CD80 gene specific primer-probe set. Quantification of the number of detected virus genomes per cell demonstrated that NG-348 and Ad5-348 replicated in both cell lines (FIGS. 56B and 56C). No virus genomes could be detected in uninfected cells (data not shown).

Example 23: Cell Surface Expression of the T Cell Activating Antigen, CD80, in Lung and Carcinoma Cell Lines CD80 transgene expression (assessed by flow cytometry) was compared in NG-348, Ad5-348, Ad5 and untreated A549 or HT-29 cell lines. A549 cells were seeded in 24 well plates at cell densities of 5e5 cells/well and HT-29 at cell density of 8e5 cells/well. Plates were incubated for 4 hrs, 37° C., 5% $CO_2$, before cells were either infected with 100 ppc NG-348 or Ad5 or 1 in 50 dilution of Ad5-348 or were left uninfected. CD80 protein expression was compared on the surface of A549 or HT-29 cells at 24, 48 and 72 hrs post-infection. At each time point cells were harvested and stained according to methods detailed below.

Figure 57A:
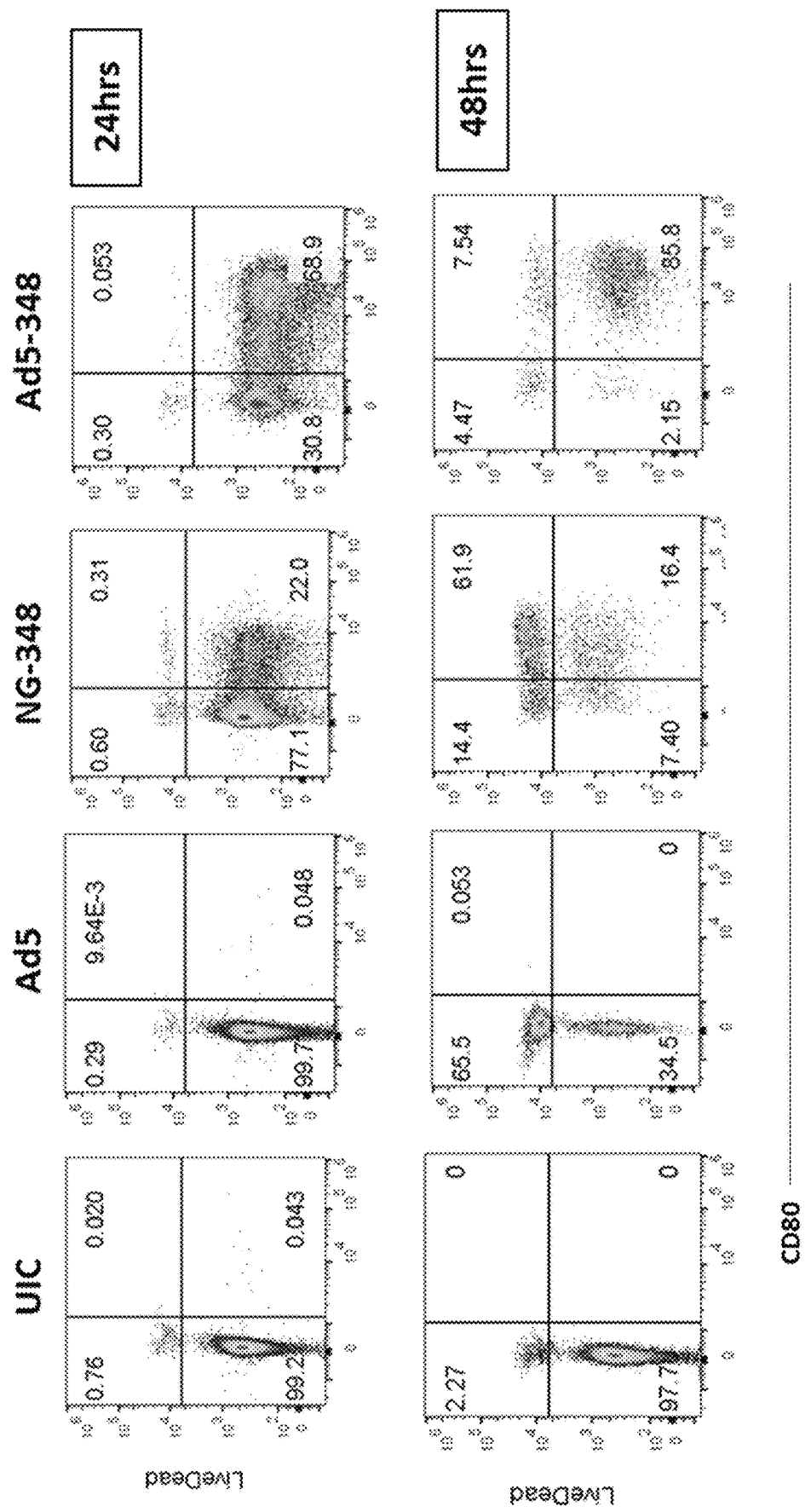
FIG. 57A-B shows analysis of CD80 expression at 24, 48 and 72 hrs post infection. CD80 could be detected on the surface of Ad5-348 and NG-348 treated A549 cells and HT-29.
Figure 57A:
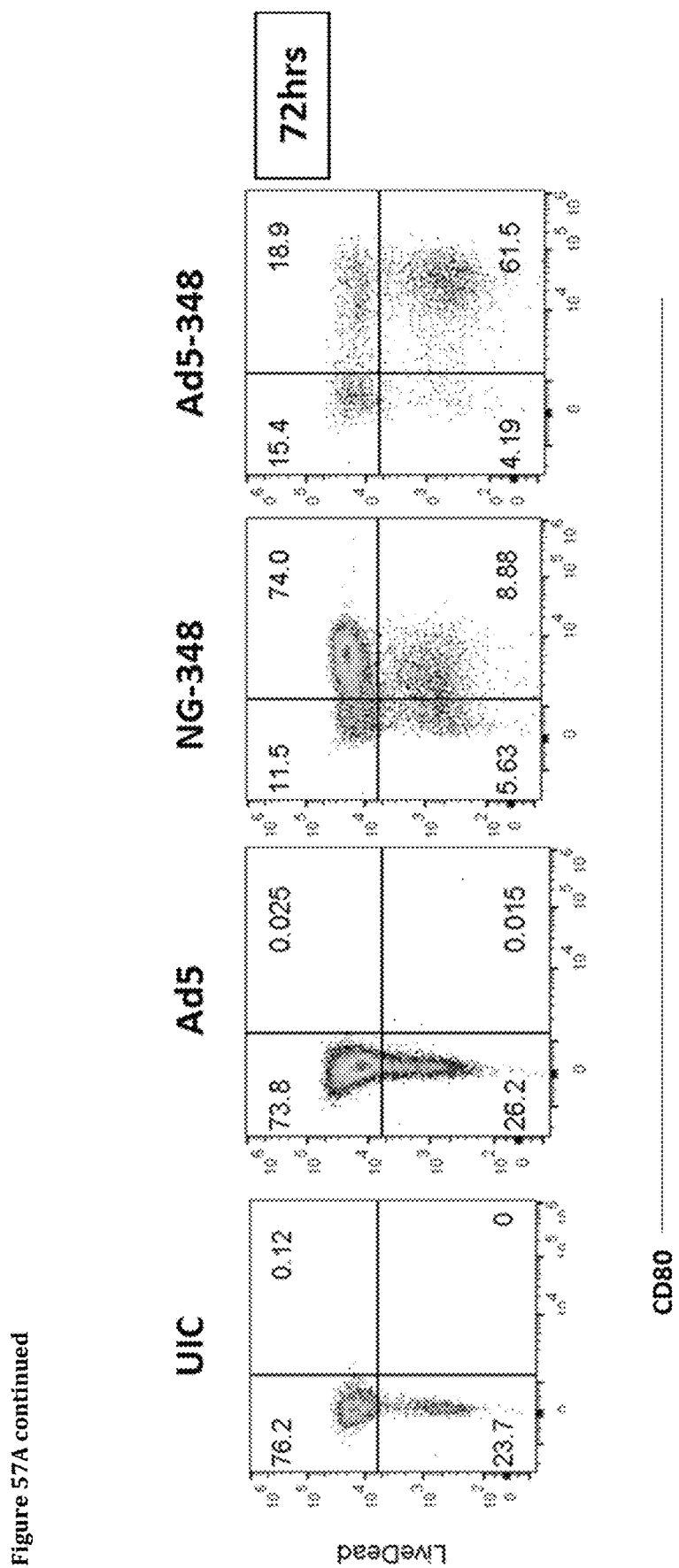
Figure 57B:
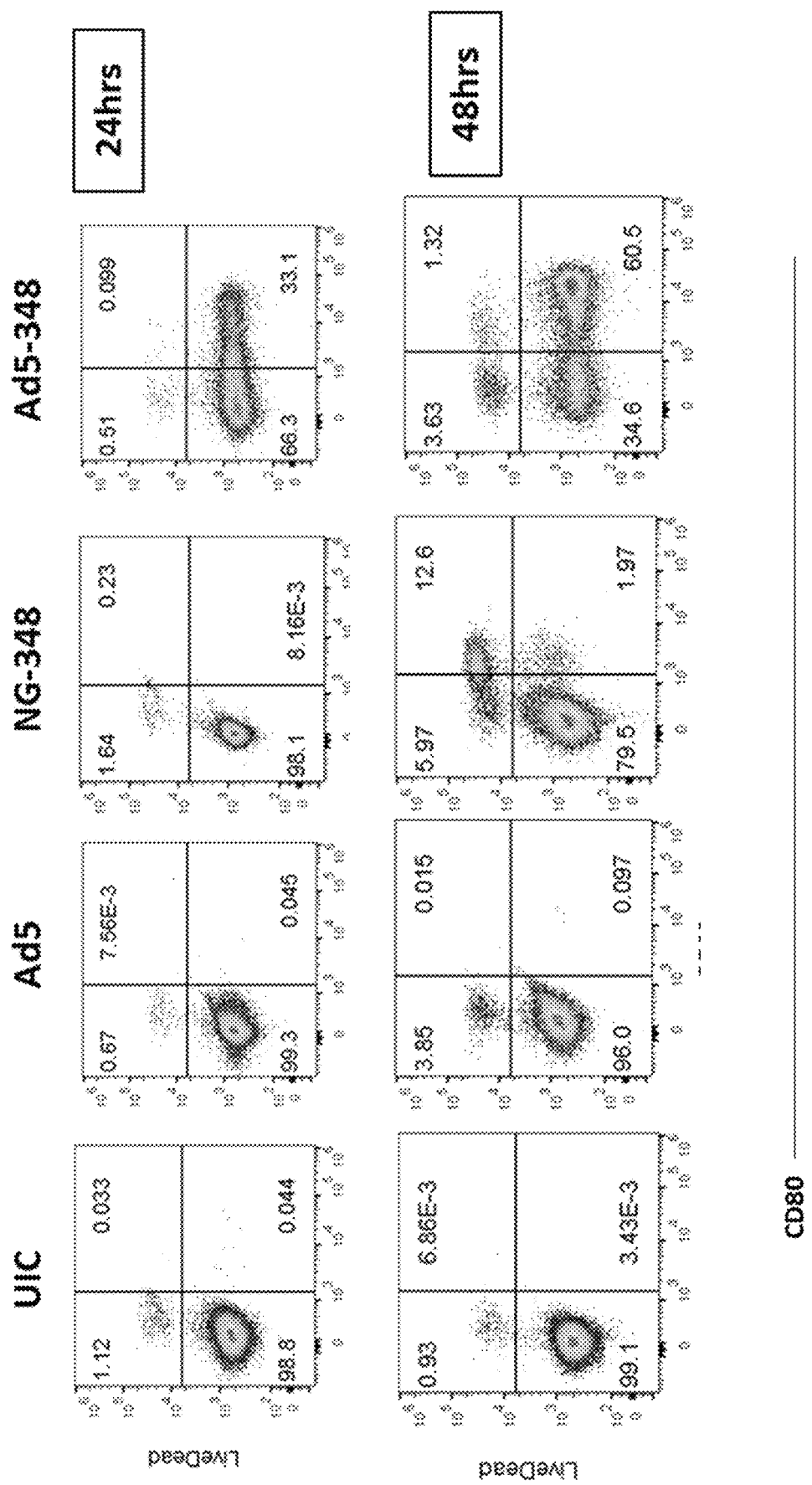
Figure 57B:
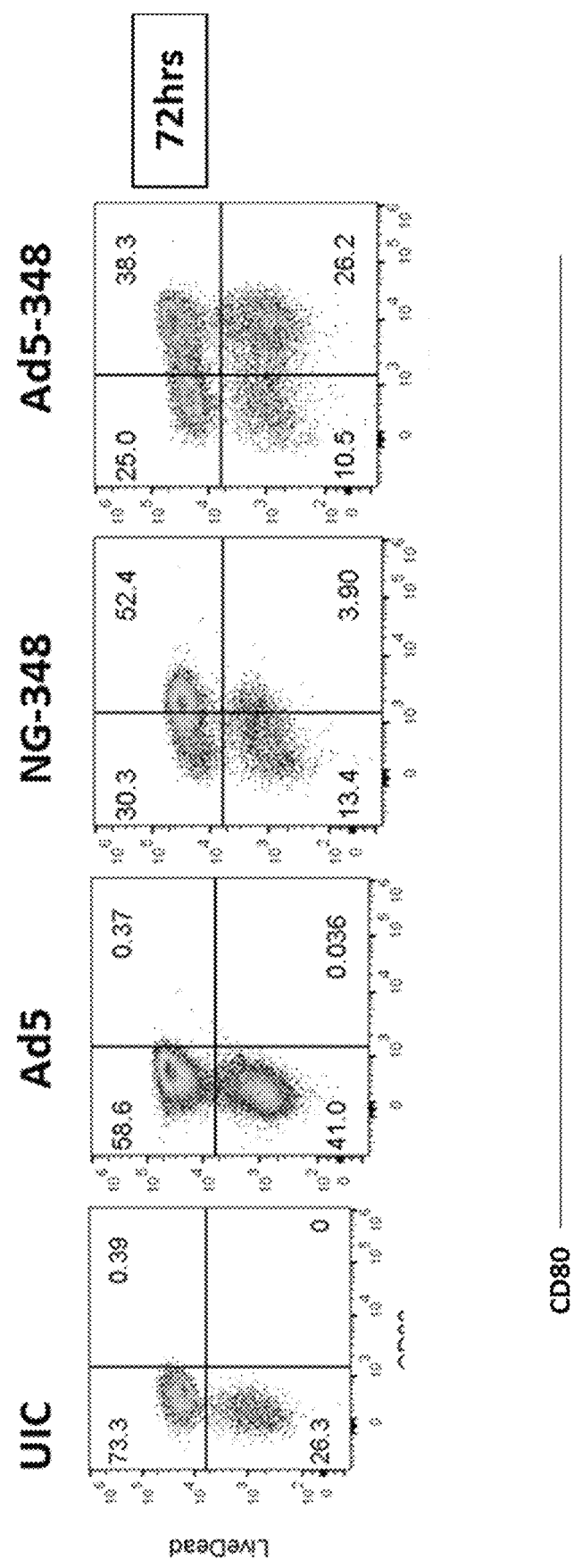

Cells were washed once with PBS before trypsin-EDTA was used to detach the cells and the trypsin was deactivated using 5% FBS DMEM media. The cells were then removed from the well, washed once with 5% FBS FACS buffer, then incubated at 5° C. for 15 minutes with either buffer, mouse isotype control antibody conjugated to BV605 or anti-human CD80 antibody conjugated to BV605 (clone 2D10). All samples were also co-stained with Aqua live/dead to differentiate viable cells. Samples were washed twice with 5% FBS/PBS before analysis by flow cytometry (FACS, Attune) for cell viability and CD80 protein expression on the cell surface. FIG. 2 shows CD80 expression after infection with 100 ppc NG-348 and Ad5 and 1 in 50 dilutions of Ad5-348. CD80 expression could only be detected on A549 or HT-29 cells infected with NG-348 or Ad5-348 virus. Analysis of CD80 expression at 24, 48 and 72 hrs post infection showed CD80 could be detected on the surface of Ad5-348 and NG-348 treated A549 cells (FIG. 57A) and HT-29 cells (FIG. 57B) at all timepoints assayed. By 72 hrs post infection transgene expression can be detected in >50% of HT-29 and >80% of A549 NG-348 or Ad5-348 infected cells.

Example 24: T Cell Activation and Degranulation Mediated By NG-348 or Ad5-348 Infected Carcinoma Cell Lines A549 or HT-29 cell lines, either infected with NG-348, Ad5 (100 ppc), Ad5-348 (diluted 1 in 50) or left uninfected, were co-cultured with T cells isolated from human PBMC donors. T cell activation was assessed by analysing cell surface activation marker CD25 (by Flow cytometry), CD107a cell surface expression as a marker for degranulation (by Flow cytometry) and secretion of stimulatory cytokine, IFNγ (by ELISA).

A549 or HT-29 cells were seeded into 24 well plates at a density of 5e5 cells/well and 8e5 cells/well, respectively. Plates were incubated for 4 hrs, 37° C., 5% $CO_2$, before cells were either infected or were left uninfected. At 48 hrs post-infection $CD3^+$ T cells, isolated by negative selection from PBMCs (MACs) were added to the A549 or HT-29 cell monolayers at a ratio of 2 T cells:1 tumour cell. The co-culture was carried out for 16 hrs, after which point cellular supernatants were collected for ELISA analysis and T cells harvested for Flow cytometry analysis.

Culture media containing non-adherent cells was removed from co-culture wells and centrifuged (300×g). The supernatant was carefully removed, diluted 1 in 2 with PBS 5% BSA and stored for ELISA analysis. The adherent cell monolayers were washed once with PBS and then detached using trypsin. The trypsin was inactivated using 10% FBS RPMI media and the cells were added to the cell pellets that had been collected from the culture supernatants. The cells were centrifuged (300×g), the supernatant discarded and the cell pellet washed in 200 μL of PBS. The cells were centrifuged again then resuspended in 50 μL of PBS containing Live/Dead Aqua (Life tech) for 15 minutes at RT. The cells were washed once in FACs buffer before staining with panels of directly conjugated antibodies: anti-CD3 conjugated to AF700; anti-CD25 conjugated to BV421; anti-CD107a conjugated to FITC. A sample of cells from each co-culture condition was also stained with relevant isotype control antibodies. All staining was carried out in FACs buffer in a total volume of 50 μL/well for 15 minutes, 4° C. Cells were then washed twice with FACs buffer (200 μL) before resuspension in 200 μL of FACs buffer and analysis by Flow cytometry (Attune).

Upregulation of T Cell Activation and Degranulation Markers

Figure 58A:
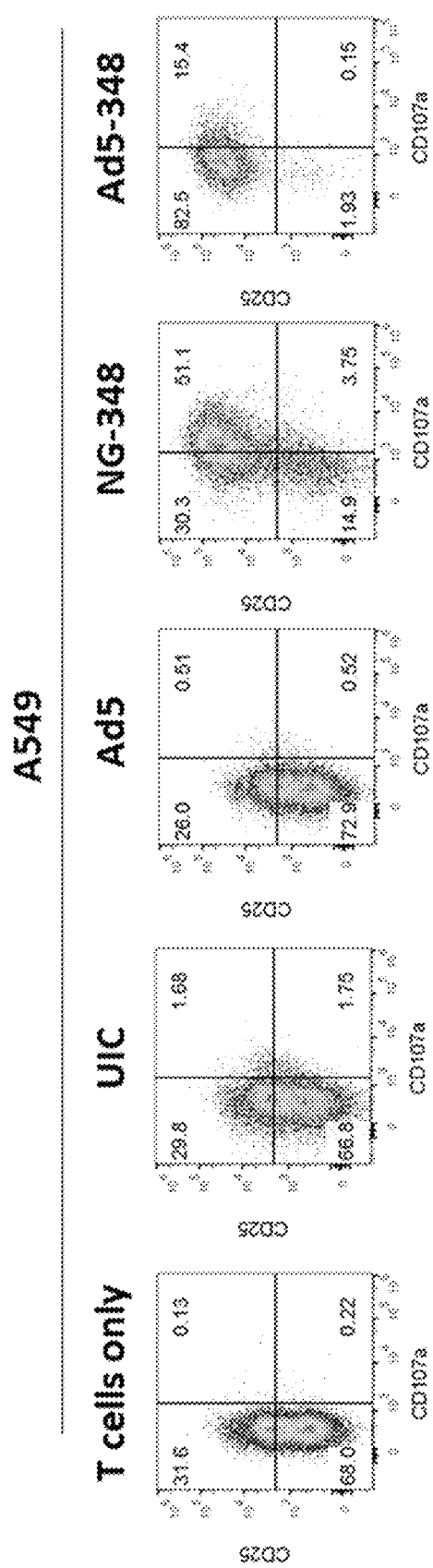
FIG. 58A-B shows flow cytometry analysis of T cell activation assessed by expression of the T cell activation marker CD25 and the marker for T cell degranulation, CD107a on live, CD3+, single cells.
Figure 58B:
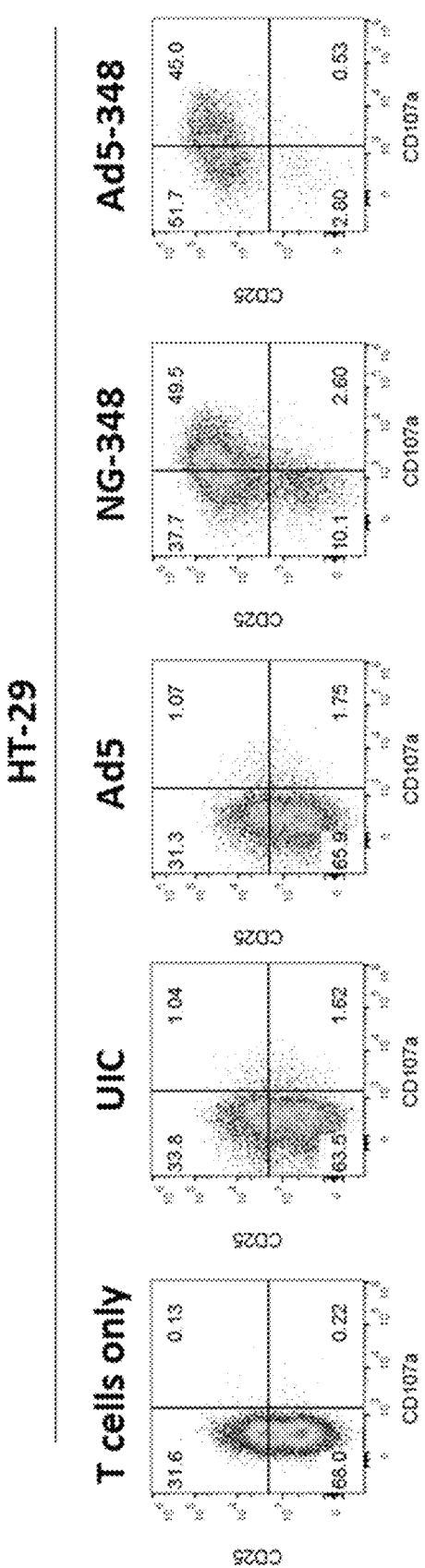

Flow cytometry analysis of T cell activation was assessed by expression of the T cell activation marker CD25 and the marker for T cell degranulation, CD107a on live, $CD3^+$, single cells. These data showed that the number of CD4 and CD8 T cells expressing CD25 and CD107a was significantly higher for T cells cultured with NG-348 or Ad5-348 infected A549 or HT-29 cells than Ad5 or uninfected controls. Similar levels of T cell activation were demonstrated with the NG-348 and Ad5-348 viruses (FIGS. 58A and B).

Secretion of the Stimulatory Cytokine IFNγ

For detection of IFNγ expression, co-culture supernatants from the experiment detailed above were diluted into 5% BSA/PBS assay buffer (in a range of 1:20 to 1:50) and ELISA was carried out using the human IFNγ Quantikine kit (R and D systems) according to the manufacturer's protocol. The concentration of secreted IFNγ was determined by interpolating from the standard curve. Expression of IFNγ could only be detected in the supernatants of co-cultures using NG-348 or Ad5-348 infected A549 or HT-29 cells and was not detectable in either the Ad5 or untreated controls (FIG. 58C).

In addition, IFNγ expression was assayed by ELISA from co-cultures of HSV and vaccinia virus infected HT-29 cells with T cells, described in examples 2 and 4. ELISA was carried out using the human IFNγ Quantikine kit (R and D systems) according to the manufacturer's protocol. The concentration of secreted IFNγ was determined by interpolating from the standard curve. Expression of IFNγ could only be detected in the supernatants of co-cultures using viruses that expressed the transgene cassette (HSV-X-8.1, WR-434 and Wy-434) infected HT-29 cells and was not detectable in either the HSV.GFP, WR-wt, Wy-wt or untreated controls (FIG. 58D).

SEQUENCE LISTING (127 sequences)

SEQ ID NO: 1 - protein, 119 aa, Artificial Sequence [sequence omitted]

SEQ ID NO: 2 - protein, 107 aa, Artificial Sequence
  Muromonab-CD3 (OKT3) VL
DIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 3 - protein, 241 aa, Artificial Sequence
  Muromonab -CD3 (OKT3) single chain Fv
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 4 - protein, 322 aa, Artificial Sequence
  Membrane anchored form of the anti-human CD3 single chain Fv
MGWSCIILFLVATATGVHSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGSEQKLISEEDLNAVGQDTQEVIVVPHSLPFKVVVISAILALVVLTIISLIILIMLWQKKPR

SEQ ID NO: 5 - protein, 333 aa, Artificial Sequence
  Membrane anchored form of anti-human CD3 single chain Fv with C-terminal V5 tag
MGWSCIILFLVATATGVHSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGSEQKLISEEDLNAVGQDTQEVIVVPHSLPFKVVVISAILALVVLTIISLIILIMLWQKKPRGSIPNPLLGLD

SEQ ID NO: 6 - protein, 119 aa, Artificial Sequence [sequence omitted]

SEQ ID NO: 7 - protein, 107 aa, Artificial Sequence
  Teplizumab VL sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 8 - protein, 449 aa, Artificial Sequence
  Teplizumab Heavy chain sequence
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9 - protein, 213 aa, Artificial Sequence
  Teplizumab Light Chain Sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10 - protein, 20 aa, Artificial Sequence
  PDGFR Receptor A
AVLVLLVIVIISLIVLVVIW

SEQ ID NO: 11 - protein, 21 aa, Artificial Sequence
  PDGFR Receptor B
VVISAILALVVLTIISLIILI

SEQ ID NO: 12 - protein, 24 aa, Artificial Sequence
  Insulin-Like growth factor 1
IIIGPPLIFVFLFSVVIGSIYLFL

SEQ ID NO: 13 - protein, 28 aa, Artificial Sequence
  IL6-R
SSSVPLPTFLVAGGSLAFGTLLCIAIVL

SEQ ID NO: 14 - protein, 27 aa, Artificial Sequence
  CD28
FWVLVVVGGVLACYSLLVTVAFIIFWV

SEQ ID NO: 15 - protein, 49 aa, Artificial Sequence
  PDGFR TM Domain
AVGQDTQEVIVVPHSLPFKVVVISAILALVVLTIISLIILIMLWQKKPR

SEQ ID NO: 16 - protein, 10 aa, Artificial Sequence
  c-myc tag
EQKLISEEDL

SEQ ID NO: 17 - protein, 13 aa, Artificial Sequence
  c-myc tag with spacers
GSEQKLISEEDLN

SEQ ID NO: 18 - protein, 62 aa, Artificial Sequence
  PDGFR TM Domain with N-terminal c-myc tag
GSEQKLISEEDLNAVGQDTQEVIVVPHSLPFKVVVISAILALVVLTIISLIILIMLWQKKPR

SEQ ID NO: 19 - protein, 19 aa, Artificial Sequence
  HuVH human VH leader sequence
MGWSCIILFLVATATGVHS

SEQ ID NO: 20 - protein, 15 aa, Artificial Sequence
  Linker
GGGGSGGGGSGGGGS

SEQ ID NO: 21 - DNA, 32326 bp, Artificial Sequence
  EnAd Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 22 - protein, 8 aa, Artificial Sequence
  hinge linker sequence
DKTHTCAA

SEQ ID NO: 23 - protein, 11 aa, Artificial Sequence
  hinge linker sequence
DKTHTCPPCPA

SEQ ID NO: 24 - protein, 18 aa, Artificial Sequence
  hinge linker sequence
DKTHTCPPCPATCPPCPA

SEQ ID NO: 25 - protein, 25 aa, Artificial Sequence
  hinge linker sequence
DKTHTCPPCPATCPPCPATCPPCPA

SEQ ID NO: 26 - protein, 30 aa, Artificial Sequence
  hinge linker sequence
DKTHTCPPCPAGKPTLYNSLVMSDTAGTCY

SEQ ID NO: 27 - protein, 31 aa, Artificial Sequence
  hinge linker sequence
DKTHTCPPCPAGKPTHVNVSVVMAEVDGTCY

SEQ ID NO: 28 - protein, 15 aa, Artificial Sequence
  hinge linker sequence
DKTHTCCVECPPCPA

SEQ ID NO: 29 - protein, 26 aa, Artificial Sequence
  hinge linker sequence
DKTHTCPRCPEPKSCDTPPPCPRCPA

SEQ ID NO: 30 - protein, 11 aa, Artificial Sequence
  hinge linker sequence
DKTHTCPSCPA

SEQ ID NO: 31 - protein, 7 aa, Artificial Sequence
  flexible linker sequence
SGGGGSE

SEQ ID NO: 32 - protein, 6 aa, Artificial Sequence
  flexible linker sequence
DKTHTS

SEQ ID NO: 33 - protein, 6 aa, Artificial Sequence
  flexible linker sequence
  misc_feature (1)..(1): Xaa is absent or S
XGGGGS

SEQ ID NO: 34 - protein, 11 aa, Artificial Sequence
  flexible linker sequence
  misc_feature (1)..(1): Xaa is absent or S
XGGGGSGGGGS

SEQ ID NO: 35 - protein, 16 aa, Artificial Sequence
  flexible linker sequence
  misc_feature (1)..(1): Xaa is absent or S
XGGGGSGGGGSGGGGS

SEQ ID NO: 36 - protein, 21 aa, Artificial Sequence
  flexible linker sequence
  misc_feature (1)..(1): Xaa is absent or S
XGGGGSGGGGSGGGGSGGGGS

SEQ ID NO: 37 - protein, 26 aa, Artificial Sequence
  flexible linker sequence
  misc_feature (1)..(1): Xaa is absent or S
XGGGGSGGGGSGGGGSGGGGSGGGGS

SEQ ID NO: 38 - protein, 11 aa, Artificial Sequence
  flexible linker sequence
AAAGSGGASAS

SEQ ID NO: 39 - protein, 16 aa, Artificial Sequence
  flexible linker sequence
  misc_feature (7)..(7): X represents an amino acid
AAAGSGXGGGSGASAS

SEQ ID NO: 40 - protein, 21 aa, Artificial Sequence
  flexible linker sequence
  misc_feature (7)..(7): X represents an amino acid
  misc_feature (12)..(12): X represents an amino acid
AAAGSGXGGGSXGGGSGASAS

SEQ ID NO: 41 - protein, 26 aa, Artificial Sequence
  flexible linker sequence
  misc_feature (7)..(7): X represents an amino acid
  misc_feature (12)..(12): X represents an amino acid
  misc_feature (17)..(17): X represents an amino acid
AAAGSGXGGGSXGGGSXGGGSGASAS

SEQ ID NO: 42 - protein, 31 aa, Artificial Sequence
  flexible linker sequence
  misc_feature (7)..(7): X represents an amino acid
  misc_feature (12)..(12): X represents an amino acid
  misc_feature (17)..(17): X represents an amino acid
  misc_feature (22)..(22): X represents an amino acid
AAAGSGXGGGSXGGGSXGGGSXGGGSGASAS

SEQ ID NO: 43 - protein, 13 aa, Artificial Sequence
  flexible linker sequence
  misc_feature (7)..(7): X represents an amino acid
AAAGSGXSGASAS

SEQ ID NO: 44 - protein, 28 aa, Artificial Sequence
  flexible linker sequence
PGGNRGTTTTRRPATTTGSSPGPTQSHY

SEQ ID NO: 45 - protein, 11 aa, Artificial Sequence
  flexible linker sequence
ATTTGSSPGPT

SEQ ID NO: 46 - protein, 6 aa, Artificial Sequence
  flexible linker sequence
ATTTGS

SEQ ID NO: 47 - protein, 21 aa, Artificial Sequence
  Flexible linker sequence
EPSGPISTINSPPSKESHKSP

SEQ ID NO: 48 - protein, 15 aa, Artificial Sequence
  Flexible linker sequence
GTVAAPSVFIFPPSD

SEQ ID NO: 49 - protein, 15 aa, Artificial Sequence
  Flexible linker sequence
GGGGIAPSMVGGGGS

SEQ ID NO: 50 - protein, 15 aa, Artificial Sequence
  Flexible linker sequence
GGGGKVEGAGGGGGS

SEQ ID NO: 51 - protein, 15 aa, Artificial Sequence
  Flexible linker sequence
GGGGSMKSHDGGGGS

SEQ ID NO: 52 - protein, 15 aa, Artificial Sequence
  Flexible linker sequence
GGGGNLITIVGGGGS

SEQ ID NO: 53 - protein, 15 aa, Artificial Sequence
  Flexible linker sequence
GGGGVVPSLPGGGGS

SEQ ID NO: 54 - protein, 12 aa, Artificial Sequence
  Flexible linker sequence
GGEKSIPGGGGS

SEQ ID NO: 55 - protein, 18 aa, Artificial Sequence
  Flexible linker sequence
RPLSYRPPFPFGFPSVRP

SEQ ID NO: 56 - protein, 18 aa, Artificial Sequence
  Flexible linker sequence
YPRSIYIRRRHPSPSLTT

SEQ ID NO: 57 - protein, 18 aa, Artificial Sequence
  Flexible linker sequence
TPSHLSHILPSFGLPTFN

SEQ ID NO: 58 - protein, 18 aa, Artificial Sequence
  Flexible linker sequence
RPVSPFTFPRLSNSWLPA

SEQ ID NO: 59 - protein, 18 aa, Artificial Sequence
  Flexible linker sequence
SPAAHFPRSIPRPGPIRT

SEQ ID NO: 60 - protein, 18 aa, Artificial Sequence
  Flexible linker sequence
APGPSAPSHRSLPSRAFG

SEQ ID NO: 61 - protein, 18 aa, Artificial Sequence
  Flexible linker sequence
PRNSIHFLHPLLVAPLGA

SEQ ID NO: 62 - protein, 18 aa, Artificial Sequence
  Flexible linker sequence
MPSLSGVLQVRYLSPPDL

SEQ ID NO: 63 - protein, 18 aa, Artificial Sequence
  Flexible linker sequence
SPQYPSPLTLTLPPHPSL

SEQ ID NO: 64 - protein, 18 aa, Artificial Sequence
  Flexible linker sequence
NPSLNPPSYLHRAPSRIS

SEQ ID NO: 65 - protein, 17 aa, Artificial Sequence
  Flexible linker sequence
LPWRTSLLPSLPLRRRP

SEQ ID NO: 66 - protein, 18 aa, Artificial Sequence
  Flexible linker sequence
PPLFAKGPVGLLSRSFPP

SEQ ID NO: 67 - protein, 18 aa, Artificial Sequence
  Flexible linker sequence
VPPAPVVSLRSAHARPPY

SEQ ID NO: 68 - protein, 17 aa, Artificial Sequence
  Flexible linker sequence
LRPTPPRVRSYTCCPTP

SEQ ID NO: 69 - protein, 18 aa, Artificial Sequence
  Flexible linker sequence
PNVAHVLPLLTVPWDNLR

SEQ ID NO: 70 - protein, 18 aa, Artificial Sequence
  Flexible linker sequence
CNPLLPLCARSPAVRTFP

SEQ ID NO: 71 - protein, 11 aa, Artificial Sequence
  linker sequence
GAPAPAAPAPA

SEQ ID NO: 72 - protein, 4 aa, Artificial Sequence
  linker sequence
PPPP

SEQ ID NO: 73 - protein, 11 aa, Artificial Sequence
  Linker sequence
DLCLRDWGCLW

SEQ ID NO: 74 - protein, 11 aa, Artificial Sequence
  Linker sequence
DICLPRWGCLW

SEQ ID NO: 75 - protein, 15 aa, Artificial Sequence
  Linker sequence
MEDICLPRWGCLWGD

SEQ ID NO: 76 - protein, 20 aa, Artificial Sequence
  Linker sequence
QRLMEDICLPRWGCLWEDDE

SEQ ID NO: 77 - protein, 20 aa, Artificial Sequence
  Linker sequence
QGLIGDICLPRWGCLWGRSV

SEQ ID NO: 78 - protein, 21 aa, Artificial Sequence
  Linker sequence
QGLIGDICLPRWGCLWGRSVK

SEQ ID NO: 79 - protein, 15 aa, Artificial Sequence
  Linker sequence
EDICLPRWGCLWEDD

SEQ ID NO: 80 - protein, 18 aa, Artificial Sequence
  Linker sequence
RLMEDICLPRWGCLWEDD

SEQ ID NO: 81 - protein, 16 aa, Artificial Sequence
  Linker sequence
MEDICLPRWGCLWEDD

SEQ ID NO: 82 - protein, 15 aa, Artificial Sequence
  Linker sequence
MEDICLPRWGCLWED

SEQ ID NO: 83 - protein, 18 aa, Artificial Sequence
  Linker sequence
RLMEDICLARWGCLWEDD

SEQ ID NO: 84 - protein, 20 aa, Artificial Sequence
  Linker sequence
EVRSFCTRWPAEKSCKPLRG

SEQ ID NO: 85 - protein, 20 aa, Artificial Sequence
  Linker sequence
RAPESFVCYWETICFERSEQ

SEQ ID NO: 86 - protein, 11 aa, Artificial Sequence
  Linker sequence
EMCYFPGICWM

SEQ ID NO: 87 - DNA, 5288 bp, Artificial Sequence
  DNA sequence corresponding to E2B region of the ENAD GENOME (BP 10355-5068)
ctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcat

SEQ ID NO: 88 - DNA, 201 bp, Artificial Sequence
  A non-coding sequence suitable for inclusion into BX
aaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccag

SEQ ID NO: 89 - DNA, 34 bp, Artificial Sequence
  A non-coding sequence suitable for inclusion into BY
caaataaagtttaacttgtttatttgaaaatcaa

SEQ ID NO: 90 - DNA, 14 bp, Artificial Sequence
  Splice acceptor sequence
tttctctcttcagg

SEQ ID NO: 91 - DNA, 26 bp, Artificial Sequence
  Splice acceptor sequence
tgctaatcttcctttctctcttcagg

SEQ ID NO: 92 - RNA, 13 nt, Artificial Sequence
  sequence comprising a start codon
gccgccrccaugg

SEQ ID NO: 93 - DNA, 550 bp, Artificial Sequence
  Internal Ribosome Entry Sequence (IRES)
gttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataata

SEQ ID NO: 94 - protein, 22 aa, Artificial Sequence
  High efficiency self-cleavable P2A peptide sequence
GSGATNFSLLKQAGDVEENPGP

SEQ ID NO: 95 - protein, 21 aa, Artificial Sequence
  High efficiency self-cleavable F2A peptide sequence
GSGEGRGSLLTCGDVEENPGP

SEQ ID NO: 96 - protein, 23 aa, Artificial Sequence
  High efficiency self-cleavable E2A peptide sequence
GSGQCTNYALLKLAGDVESNPGP

SEQ ID NO: 97 - protein, 25 aa, Artificial Sequence
  High efficiency self-cleavable T2A peptide sequence
GSGVKQTLNFDLLKLAGDVESNPGP

SEQ ID NO: 98 - protein, 288 aa, Artificial Sequence
  Human CD80 amino acid sequence
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 99 - DNA, 192 bp, Artificial Sequence
  poly adenylation sequence (SV40 late polyA sequence)
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttt

SEQ ID NO: 100 - DNA, 34522 bp, Artificial Sequence
  NG-348 virus genome sequence comprising the EnAd genome with a transgene cassette that encodes a membrane-anchored chimeric form of the single chain Fv anti-human CD3e and the T lymphocyte activation antigen, CD80 inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 101 - protein, 9 aa, Artificial Sequence
  V5 TAG
IPNPLLGLD

SEQ ID NO: 102 - DNA, 34555 bp, Artificial Sequence
  NG-348A virus genome sequence comprising the EnAd genome with a transgene cassette that encodes a membrane-anchored chimeric form of the single chain Fv anti-human CD3e with C-terminal V5 tag and the T lymphocyte activation antigen, CD80 inserted in region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggttcaatccctaaccctctcctcggtctcgatggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 103 - DNA, 33595 bp, Artificial Sequence
  NG-420 virus genome sequence comprising the EnAd genome with a transgene cassette that encodes a membrane-anchored chimeric form of the single chain Fv anti-human CD3e inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 104 - DNA, 33628 bp, Artificial Sequence
  NG-420A virus genome sequence comprising the EnAd genome with a transgene cassette that encodes a membrane-anchored chimeric form of the single chain Fv anti-human CD3e and a C-terminal V5 tag, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggttcaatccctaaccctctcctcggtctcgattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 105 - DNA, 5431 bp, Artificial Sequence
  NG-444-R in pUC57-Kan plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatgaattcacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggccccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcccgggatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 106 - DNA, 7915 bp, Artificial Sequence
  434-MVA-GFP+transgene
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcatctggaaacgggcatctccatttaagactagatgccacggggtttaaaatactaatcatgacattttgtagagcgtaattacttagtaaatccgccgtactaggttcatttcctcctcgtttggatctcacatcagaaattaaaataatcttagaaggatgcagttgttttttgatggatcgtagatattcctcatcaacgaaccgagtcactagagtcacatcacgcaatccatttaaaataggatcatgatggcggccgtcaattagcatccatttgatgatcactcctaaattatagaaatgatctctcaaataacgtatatgtgtaccgggagcagatcctatatacactacggtggcaccatctaatataccgtgtcgctgtaacttactaagaaaaaataattctcctagtaatagttttaactgtccttgatacggtagtttttttgcgacctcatttgcactttctggttcgtaatctaactcattatcaatttcctcaaaatacataaacggtttatctaacgacacaacatccatttttaagtattatattaaaatttaatcaatgtttatttttagttttttagataaaaaatataatattatgagtcgatgtaacactttctacacaccgattgatacatatcattacctcctattatctctatctcggtttcctcacccaatcgtttagaaaaggaagcctccttaaagcatttcatacacacagcagttagttttaccaccatttcagataatggaataagattcaaaatattattaaacggtttacgttgaaatgtcccatcgagtgcggctactataactatttttccttcgtttgccatacagatcctacgtactcgagcccgggatagctgacgactaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgtgagctgaaggtacgctgtatctcagtcagtcaagctagcttatacagggcgtacactttcccttctcaatctctcattcctccttctctctctgcatcttggggcaaagcagtaggtcaggcagcatatcacaaaaattccatttactgagattaaggtaatggcccaggatgggagcaggttatcaggaaaatgctcttgcttggttgtattccagttgaaggtctgattcactcttaaatgtccatacttgatgagacacatgaagctgtggttggttgtcatattgaaatccagtttgctgctaacagcatagagctcagtttcaggatcttgggaaactgttgtgttgatggcatttaattcttctccattttccaaccaggagaggtgaggctctggaaaacctccagaggttgagcaaattatccttctaatattagaagttggaatttcaaagtcagatatactaggtgtagggaagtcagctttgactgataacgtcacttcagccaggtgttcccgcttgaaagcgtctttttcatacttcagaacaacacactcgtatgtgccctcgtcagatgggcgcagagccaggatcacaatggagaggttattagtgatatcaaagatggtccggttcttgtactcgggccatatattcatgtccccagacatcatagtcagcaccattttcttctccttttgccagtagatgcgagtttgtgccagctcttcaacagaaacattgtgaccacaggacagcgttgccacttctttcacttccttggtcacgtggataacacctgaacagaagtgagaaagaccagccagcaccaagagctgaaagaaattgaggtatggacacttggatggtgatgttccctgcctccgtgtgtggccaggtccagggttctcctccacgtctccagcctgcttcagcaggctgaagttagtagctccgcttccacgtggcttcttctgccaaagcatgatgaggatgataagggagatgatggtgagcaccaccagggccaggatggctgagatcaccaccaccttaaagggcaaggagtgtggcaccacgatgacctcctgcgtgtcctggcccacagcattcagatcctcttctgagatgagtttttgttcggatccccggtttatttccaactttgtccccgagccgaacgtgaatgggttactactccactgctggcagtaataagtggcagcatcttcagcctccatgccgctgattgtgagagagtaagaggtcccagacccactgcccctgaagtgagcagggactccagaagccagtttggatgtgtcataaatccatcttttgggggaggtgcctgacttctgctggtaccagttcatgtaacttacacttgagctggcactgcaggtcatggtgaccttctcccctggagatgcagacatgattgctggagactgagtgagcacgatatcagatccgccgccaccagatccaccaccgcccgagccaccgccacctgaggagactgtgagagtggtgccttggccccagtagtcaaggcagtaatgatcatcataatatcttgcacagtaatagactgcagagtcctcagatgtcaggctgctcagttgcatgtaggctgtgctggaggatttgtctgtagtcaatgtggccttgtccttgaacttctgattgtaattagtataaccacggctaggattaatgtatccaatccattccagaccctgtccaggcctctgttttacccagtgcatcgtgtacctagtaaaggtgtagccagaagccttgcaggacatcttcactgaggccccaggtcttgccagttcagccccagactgctgcagctgcacctgggagtggacacctgtagctgttgctaccaagaagaggatgatacagctccatcccatggtgggctcgagggtaccggatctagatggggatccgtcactgttctttatgattctacttccttaccgtgcaataaattagaatatattttctacttttacgagaaattaattattgtatttattatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacctgcaggtcgacgaagttcctatactttctagagaataggaacttcgcagccaagctggaattcatccactttggataagaaatctgcatgataaatatattgatatcctaccacctattaaagtaccattatctaatagcaataagatagataaacaaatgttttttgatgaagttattacgtggataaatatatatcttcaggaaaagggtattatgttaccagatgatataagagaactcagagatgctattattccttaactagttacgtctctttaggtacttattttgatacgttacaagtaaaaaactatcaaatataaatggaatctgattctaatatagcgattgaagaggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgcgaagttcctatactttctagagaataggaacttcaacaatgtctggaaagaactgtccttcatcgatacctatcacggagaaatctgtaattgattccaagacatcacatagtttagttgcttccaatgcttcaaaattattcttatcatgcgtccatagtcccgttccgtatctattatcgttagaatattttatagtcacgcatttatattgagctatttgataacgtctaactcgtctaattaattctgtacttttacctgaaaacatggggccgattatcaactgaatatgtccgccgttcatgatgacaataaagaattaattattgttcactttattcgactttaatatatccatcacgttagaaaatgcgatatcgcgacgaggatctatgtatctaacaggatctattgcggtggtagctagagctgattcttttttgaatcgcatcaaactaatcacaaagtcgaacaaatatcctttattaagtttgacccttccatctgtaacaatagggaccttgttaaacagttttttaaaatcttgagagtctgtgaattttgtcaattgtctgtattcctctgaaagagattcataacaatgacccacggcttctaatttattttttgattggatcaataataataacagaaagtctagatattgagtgatttgcaatatatcagataatgaagattcatcatcttgactagccaaatacttaaaaaatgaatcatcatctgcgaagaacatcgttaagagatactggttgtgatccatttatgagctcgcgaaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 107 - DNA, 7747 bp, Artificial Sequence
  1863-MVA-GFP+transgene
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcatctggaaacgggcatctccatttaagactagacgccacggggtttaaaatactaatcatgacattttgtagagcgtaattacttagtaaatccgccgtactaggttcatttcctcctcgtttggatctcacatcagaaattaaaataatcttagaaggatgcagttgttttttgatggatcgtagatattcctcatcaacgaaccgagtcactagagtcacatcacgcaatccatttaaaataggatcatgatggcggccgtcaattagcatccatttgatgatcactcctaaattatagaaatgatctctcaaataacgtatatgtgtaccgggagcagatcctatatacactacggtggcaccatctaatataccgtgtcgctgtaacttactaagaaaaaataattctcctagtaatagttttaactgtccttgatacggcagtttttttgcgacctcatttgcactttctggttcgtaatctaactcattatcaatttcctcaaaatacataaacggtttatctaacgacacaacatccatttttaagtattatattaaaatttaatcaatgtttatttttagttttttagataaaaaatataatattatgagtcgatgtaacactttctacacaccgattgatacatatcattacctcctattatttctatctcggtttcctcacccaatcgtttagaaaaggaagcctccttaaagcatttcatacacacagcagttagttttaccaccatttcagataatggaataagattcaaaatattattaaacggtttacgttgaaatgtcccatcgagtgcggctactataactaatttttccttcgtttgcctacagatcctacgtactcgagcccgggatagctgacgactaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgtgagctgaaggtacgctgtatctcagtcagtcaagctagcttatacagggcgtacactttcccttctcaatctctcattcctccttctctctctgcatcttggggcaaagcagtaggtcaggcagcatatcacaaaaattccatttactgagattaaggtaatggcccaggatgggagcaggttatcaggaaaatgctcttgcttggttgtattccagttgaaggtctgattcactcttaaatgtccatacttgatgagacacatgaagctgtggttggttgtcatattgaaatccagtttgctgctaacagcatagagctcagtttcaggatcttgggaaactgttgtgttgatggcatttaattcttctccattttccaaccaggagaggtgaggctctggaaaacctccagaggttgagcaaattatccttctaatattagaagttggaatttcaaagtcagatatactaggtgtagggaagtcagctttgactgataacgtcacttcagccaggtgttcccgcttgaaagcgtctttttcatacttcagaacaacacactcgtatgtgccctcgtcagatgggcgcagagccaggatcacaatggagaggttattagtgatatcaaagatggtccggttcttgtactcgggccatatattcatgtccccagacatcatagtcagcaccattttcttctccttttgccagtagatgcgagtttgtgccagctcttcaacagaaacattgtgaccacaggacagcgttgccacttctttcacttccttggtcacgtggataacacctgaacagaagtgagaaagaccagccagcaccaagagctgaaagaaattgaggtatggacacttggatggtgatgttccctgcctccgtgtgtggccaggtccagggttctcctccacgtctccagcctgcttcagcaggctgaagttagtagctccgcttccacgtggcttcttctgccaaagcatgatgaggatgataagggagatgatggtgagcaccaccagggccaggatggctgagatcaccaccaccttaaagggcaaggagtgtggcaccacgatgacctcctgcgtgtcctggcccacagcattcagatcctcttctgagatgagtttttgttcggatccccggtttatttccaactttgtccccgagccgaacgtgaatgggttactactccactgctggcagtaataagtggcagcatcttcagcctccatgccgctgattgtgagagagtaagaggtcccagacccactgcccctgaagtgagcagggactccagaagccagtttggatgtgtcataaatccatcttttgggggaggtgcctgacttctgctggtaccagttcatgtaacttacacttgagctggcactgcaggtcatggtgaccttctcccctggagatgcagacatgattgctggagactgagtgagcacgatatcagatccgccgccaccagatccaccaccgcccgagccaccgccacctgaggagactgtgagagtggtgccttggccccagtagtcaaggcagtaatgatcatcataatatcttgcacagtaatagactgcagagtcctcagatgtcaggctgctcagttgcatgtaggctgtgctggaggatttgtctgtagtcaatgtggccttgtccttgaacttctgattgtaattagtataaccacggctaggattaatgtatccaatccattccagaccctgtccaggcctctgttttacccagtgcatcgtgtacctagtaaaggtgtagccagaagccttgcaggacatcttcactgaggccccaggtcttgccagttcagccccagactgctgcagctgcacctgggagtggacacctgtagctgttgctaccaagaagaggatgatacagctccatcccatggtgggctcgaggcggccgcggtaccggatcctacgatacaaacttaacggatatcgcgataatgaaattatttatgattatttctcgctttcaatttaacacaaccctcaagaacctttgtatttattttcaatttttctgcaggtcgacgaagttcctatactttctagagaataggaacttcgcagccaagctggaattcatccactttggataagaaatctgcatgataaatatattgatatcctaccacctattaaagtaccattatctaatagcaataagatagataaacaaatgttttttgatgaagttattacgtggataaatatatatcttcaggaaaagggtattatgttaccagatgatataagagaactcagagatgctattattccttaactagttacgtctctttaggtacttattttgatacgttacaagtaaaaaactatcaaatataaatggaatctgattctaatatagcgattgaagaggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgcgaagttcctatactttctagagaataggaacttcaacaatgtctggaaagaactgtccttcatcgatacctatcacggagaaatctgtaattgattccaagagatcacatagtttagttgcttccaatgcttcaaaattattcttatcatgcgtccatagtcccgttccgtatctattatcgttagaatattttatagtcacgcatttatattgagctatttgataacgtctaactcgtctaattaattctgtacttttacctgaaaacatggggccgattatcaactgaatatgtccgccgttcatgatgacaataaagaattaattattgttcactttattcgactttaatatatccatcacgttagaaaatgcgatattgcgacgaggatctatgtatctaacaggatctattgcggtggtagctagagaggattcttttttgaatcgcatcaaactaatcacaaagtcgaacaaatatcctttattaagtttgacccttccatctgtaacaatagggaccttgttaaacagttttttaaaatcttgaaagtctgtgaattttgtcaattgtctgtattcctctgaaagagattcataacaatgacccacggcttctaatttattttttgattggatcaataataataacagaaagtctagatattgagtgatttgcaatatatcagataatgaagatttcatcatcttgactagccaaatacttaaaaaatgaatcatcatctgcgaagaacatcgttaagagatactggttgtgatccatttatgagctcgcgaaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 108 - DNA, 7680 bp, Artificial Sequence
  1864-MVA-GFP+transgene
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcatctggaaacgggcatctccatttaagactagatgccacggggtttaaaatactaatcatgacattttgtagagcgtaattacttagtaaatccgccgtactaggttcatttcctcctcgtttggatctcacatcagaaattaaaataatcttagaaggatgcagttgttttttgatggatcgtagatattcctcatcaacgaaccgagtcactagagtcacatcacgcaatccatttaaaataggatcatgatggcggccgtcaattagcatccatttgatgatcactcctaaattatagaaatgatctctcaaataacgtatatgtgtaccgggagcagatcctatatacactacggtggcaccatctaatataccgtgtcgctgtaacttactaagaaaaaataattctcctagtaatagttttaactgtccttgatacggtagtttttttgcgacctcatttgcactttctggttcgtaatctaactcattatcaatttcctcaaaatacataaacggtttatctaacgacacaacatccatttttaagtattatattaaaatttaatcaatgtttatttttagttttttagataaaaaatataatattatgagtcgatgtaacactttctacacaccgattgatacatatcattacctcctattatttctatctcggtttcctcacccaatcgtttagaaaaggaagcctccttaaagcatttcatacacacagcagttagttttaccaccatttcagataatggaataagattcaaaatattattaaacggtttacgttgaaatgtcccatcgagtgcggctactataactatttttccttcgtttgccatacagatcctacgtactcgagcccgggatagctgacgactaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgtgagctgaaggtacgctgtatctcagtcagtcaagctagcttatacagggcgtacactttcccttctcaatctctcattcctccttctctctctgcatcttggggcaaagcagtaggtcaggcagcatatcacaaaaattccatttactgagattaaggtaatggcccaggatgggagcaggttatcaggaaaatgctcttgcttggttgtattccagttgaaggtctgattcactcttaaatgtccatacttgatgagacacatgaagctgtggttggttgtcatattgaaatccagtttgctgctaacagcatagagctcagtttcaggatcttgggaaactgttgtgttgatggcatttaattcttctccattttccaaccaggagaggtgaggctctggaaaacctccagaggttgagcaaattatccttctaatattagaagttggaatttcaaagtcagatatactaggtgtagggaagtcagctttgactgataacgtcacttcagccaggtgttcccgcttgaaagcgtctttttcatacttcagaacaacacactcgtatgtgccctcgtcagatgggcgcagagccaggatcacaatggagaggttattagtgatatcaaagatggtccggttcttgtactcgggccatatattcatgtccccagacatcatagtcagcaccattttcttctccttttgccagtagatgcgagtttgtgccagctcttcaacagaaacattgtgaccacaggacagcgttgccacttctttcacttccttggtcacgtggataacacctgaacagaagtgagaaagaccagccagcaccaagagctgaaagaaattgaggtatggacacttggatggtgatgttccctgcctccgtgtgtggccaggtccagggttctcctccacgtctccagcctgcttcagcaggctgaagttagtagctccgcttccacgtggcttcttctgccaaagcatgatgaggatgataagggagatgatggtgagcaccaccagggccaggatggctgagatcaccaccaccttaaagggcaaggagtgtggcaccacgatgacctcctgcgtgtcctggcccacagcattcagatcctcttctgagatgagtttttgttcggatccccggtttatttccaactttgtccccgagccgaacgtgaatgggttactactccactgctggcagtaataagtggcagcatcttcagcctccatgccgctgattgtgagagagtaagaggtcccagacccactgcccctgaagtgagcagggactccagaagccagtttggatgtgtcataaatccatcttttgggggaggtgcctgacttctgctggtaccagttcatgtaacttacacttgagctggcactgcaggtcatggtgaccttctcccctggagatgcagacatgattgctggagactgagtgagcacgatatcagatccgccgccaccagatccaccaccgcccgagccaccgccacctgaggagactgtgagagtggtgccttggccccagtagtcaaggcagtaatgatcatcataatatcttgcacagtaatagactgcagagtcctcagatgtcaggctgctcagttgcatgtaggctgtgctggaggatttgtctgtagtcaatgtggccttgtccttgaacttctgattgtaattagtataaccacggctaggattaatgtatccaatccattccagaccctgtccaggcctctgttttacccagtgcatcgtgtacctagtaaaggtgtagccagaagccttgcaggacatcttcactgaggccccaggtcttgccagttcagccccagactgctgcagctgcacctgggagtggacacctgtagctgttgctaccaagaagaggatgatacagctccatcccatggtgggctcgagataaaaagcggccttggccgaggcggccacgcgtaggcctagatctggccttaatggccggatccggtaccttatttatattccaaaaaaaaaaaataaaatttcaatttttacaaaaagaattcatccactttggataagaaatctgcatgataaatatattgatatcctaccacctattaaagtaccattatctaatagcaataagatagataaacaaatgttttttgatgaagttattacgtggataaatatatatcttcaggaaaagggtattatgttaccagatgatataagagaactcagagatgctattattccttaactagttacgtctctttaggtacttattttgatacgttacaagtaaaaaactatcaaatataaatggaatctgattctaatatagcgattgaagaggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgcgaagttcctatactttctagagaataggaacttcaacaatgtctggaaagaactgtccttcatcgatacctatcacggagaaatctgtaattgattccaagacatcacatagtttagttgcttccaatgcttcaaaattattcttatcatgcgtccatagtcccgttccgtatctattatcgttagaatattttatagtcacgcatttatattgagctatttgataacgtctaactcgtctaattaattctgtacttttacctgaaaacatggggccgattatcaactgaatatgtccgccgttcatgatgacaataaagaattaattattgttcactttattcgactttaatatatccatcacgttagaaaatgcgatatcgcgacgaggatctatgtatctaacaggatctattgcggtggtagctagagctgattcttttttgaatcgcatcaaactaatcacaaagtcgaacaaatatcctttattaagtttgacccttccatctgtaacaatagggaccttgttaaacagttttttaaaatcttgagagtctgtgaattttgtcaattgtctgtattcctctgaaagagattcataacaatgacccacggcttctaatttattttttgattggatcaataataataacagaaagtctagatattgagtgatttgcaatatatcagataatgaagattcatcatcttgactagccaaatacttaaaaaatgaatcatcatctgcgaagaacatcgttaagagatactggttgtgatccatttatgagctcgcgaaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 109 - DNA, 664 bp, Artificial Sequence
  CMV promoter
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtac

SEQ ID NO: 110 - DNA, 36245 bp, Artificial Sequence
  Ad5-348 Genome
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgaccgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattcccttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatcatcttattccctttaactaataaaaaaaaataataaagcatcacttacttaaaatcagttagcaaatttatgcatgtcgacagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataatctagaagttgtctcctcctgcactgactgactgatacaatcgatttctggatccgcaggcctctgctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctaggtcgcgatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 111 - protein, 188 aa, Artificial Sequence
  Human Interferona amino acid sequence
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 112 - protein, 179 aa, Artificial Sequence
  Human soluble Flt3 ligand amino acid sequence
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAP

SEQ ID NO: 113 - protein, 93 aa, Artificial Sequence
  Human Macrophage Inflammatory protein 1a amino acid sequence (LD78b isoform)
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 114 - protein, 322 aa, Artificial Sequence; identical to SEQ ID NO: 4
  Membrane anchored form of the anti-human CD3 single chain Fv

SEQ ID NO: 115 - DNA, 33493 bp, Artificial Sequence
  NG-330 virus genome sequence comprising the EnAd genome with a transgene cassette that encodes the T lymphocyte activation antigen, CD80, inserted in the region By. The transgene cassette contains a 5' SSA, human CD80 cDNA sequence and a 3' poly(A)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 116 - DNA, 34119 bp, Artificial Sequence
  NG-343 virus genome sequence comprising the EnAd genome with a transgene cassette that encodes IFNa, and CD80, inserted in the region By. The transgene cassette contains a 5' SSA, IFNa cDNA sequence, P2A peptide, CD80 cDNA sequence and a 3' poly(A)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 117 - DNA, 34131 bp, Artificial Sequence
  NG-345 virus genome sequence comprising the EnAd genome with a transgene cassette that encodes Flt3 Ligand, MIP1a and IFNa, inserted in the region BY. The transgene cassette contains a 5' SSA, Flt3 Ligand cDNA , P2A peptide sequence, MIP1a cDNA sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 118 - DNA, 34432 bp, Artificial Sequence
  NG-346 virus genome sequence comprising a transgene cassette that encodes Flt3 Ligand, MIP1a and CD80, employing SSA and P2A sequence, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagatagga

SEQ ID NO: 119 - DNA, 34458 bp, Artificial Sequence
  NG-347 virus genome sequence comprising a transgene cassette encoding IFNa, MIP1a and CD80, employing SSA and a P2A sequence, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 120 - DNA, 981 bp, Artificial Sequence
  E3 REGION FROM ENAD
atgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaa

SEQ ID NO: 121 - DNA, 34 bp, Artificial Sequence; identical to SEQ ID NO: 89
  A NON-CODING SEQUENCE SUITABLE FOR INCLUSION INTO BY

SEQ ID NO: 122 - DNA, 34522 bp, Artificial Sequence; identical to SEQ ID NO: 100
  NG-348 virus genome sequence comprising a transgene cassette that encoding a membrane-anchored chimeric form an anti-human CD3e scFv, and CD80 inserted in the region BY

SEQ ID NO: 123 - DNA, 966 bp, Artificial Sequence
  MEMBRANE TETHERED OKT3-SCFV NUCLEIC ACID SEQUENCE
atgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgt

SEQ ID NO: 124 - DNA, 2196 bp, Artificial Sequence
  Transgene Cassette sequence -  NG-348
gcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcagg

SEQ ID NO: 125 - DNA, 32345 bp, Artificial Sequence
  Fully synthetic EnAd genome with incorporated cloning site for transgene cassette insertion as in plasmid pEnAd2.4
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 126 - DNA, 864 bp, Artificial Sequence
  Human CD80
ggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 127 - DNA, 909 bp, Artificial Sequence
  Transmembrane form of Anti-CD3 ScFv
caggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgt

The invention claimed is:

1. A replication deficient oncolytic viral vector or replication capable oncolytic virus comprising: a first transgene encoding an anti-TCR antibody or a binding fragment thereof and a transmembrane domain or a GPI anchor, for expression on the surface of a cancer cell for in vivo stimulation of T cells, and
at least one further transgene,
wherein a 2A peptide links said genes,
wherein the transgenes are in a cassette encoded as a polycistronic mRNA, and
wherein the virus is not an adenovirus.

2. The replication deficient oncolytic viral vector or replication capable oncolytic virus of claim 1, wherein the virus is replication competent.

3. The replication deficient oncolytic viral vector or replication competent oncolytic virus of claim 2, wherein the transmembrane domain is selected from a sequence shown in SEQ ID NO: 10 to 14.

4. The replication deficient oncolytic viral vector or replication competent oncolytic virus of claim 2, wherein the oncolytic virus is herpes simplex virus, vesicular stomatitis virus, reovirus, vaccina virus, Seneca valley virus, coxsackievirus, measles, Maraba virus or Newcastle disease virus.

5. The replication deficient oncolytic viral vector or replication competent oncolytic virus of claim 2, wherein the antibody or binding fragment is a full length antibody, a Fab, modified Fab, Fab', modified Fab', $F(ab')_2$, Fv, single domain antibody, scFv, bi, tri or tetra-valent antibody, Bis-scFv, diabody, triabody, humabody, disulfide stabilised forms of any one of the same or epitope-binding fragments thereof.

6. The replication deficient oncolytic viral vector or replication competent oncolytic virus of claim 5, wherein the oncolytic virus encodes at least two further transgenes.

7. The replication deficient oncolytic viral vector or replication competent oncolytic virus of claim 2, wherein the further transgene encodes a protein independently selected from a cytokine, a chemokine, an antagonistic antibody molecule or binding fragment thereof, or an agonistic antibody molecule or binding fragment thereof, and combinations thereof.

8. The replication deficient oncolytic viral vector or replication competent oncolytic virus of claim 7, wherein at least one further transgene encodes an antibody molecule or a binding fragment thereof.

9. The replication deficient oncolytic viral vector or replication competent oncolytic virus according to claim 8, wherein the antibody molecule or binding fragment is an inhibitor.

10. The replication deficient oncolytic viral vector or a replication competent oncolytic virus of claim 7, wherein the antibody molecule or binding fragment is an agonist.

11. The replication deficient oncolytic viral vector or a replication competent oncolytic virus of claim 7, where the further transgene encodes an antibody, antibody fragment or protein ligand that binds CTLA-4, PD-1, PD-L1, CD80, CD86, GITR, IL-12, OX40, CD27, CD28, CD40, 4-1BB, or ICOS.

12. The replication deficient oncolytic viral vector or replication competent oncolytic virus of claim 2, wherein at least one further transgene encodes a cytokine.

13. The replication deficient oncolytic viral vector or replication competent oncolytic virus of claim 2, wherein a second further transgene encodes a cytokine.

14. The replication deficient oncolytic viral vector or replication competent oncolytic virus of claim 7, wherein the encoded cytokine is selected from IL-2, IFN-alpha, IFN-beta, IFN-gamma, Flt3 ligand, GM-CSF, IL-15, IL-12 and combinations thereof.

15. The replication deficient oncolytic viral vector or replication competent oncolytic virus of claim 7, wherein the cytokine is IL-2, IFN-alpha, IFN-beta, IFN-gamma, Flt3 ligand, GM-CSF, IL-15 or IL-12.

16. The replication deficient oncolytic viral vector or replication competent oncolytic virus of claim 2, wherein said at least one further transgene encodes a chemokine.

17. The replication deficient oncolytic viral vector or replication competent oncolytic virus of claim 7, wherein the chemokine is MIP-1 alpha, RANTES, IL-8, CCL5, CCL17, CCL20, CCL22, CXCL9, CXCL10, CXCL11, CXCL13, CXCL12, CCL2, CCL19 or CCL21.

18. The replication deficient oncolytic viral vector or replication competent oncolytic virus according to claim 16, wherein the virus comprises transgenes encoding a cytokine and chemokine combination selected from i) MIP-1α and Flt3, and ii) MIP-1α and IFNα.

19. The replication deficient oncolytic viral vector or replication competent oncolytic virus of claim 2, wherein the antibody or a binding fragment thereof is an anti-CD3 antibody or binding fragment thereof.

20. The replication deficient oncolytic viral vector or replication competent oncolytic virus of claim 19, wherein the anti-CD3 antibody or binding fragment has at least the binding domain comprising a VH and a VL region from muromonab-CD3 (OKT3), otelixizumab, teplizumab or visilizumab.

* * * * *